US007455992B2

(12) United States Patent
Klaenhammer et al.

(10) Patent No.: US 7,455,992 B2
(45) Date of Patent: Nov. 25, 2008

(54) *LACTOBACILLUS ACIDOPHILUS* NUCLEIC ACID SEQUENCES ENCODING PROTEASE HOMOLOGUES AND USES THEREFORE

(75) Inventors: Todd R. Klaenhammer, Raleigh, NC (US); Eric Altermann, Apex, NC (US); W. Michael Russell, Newburgh, IN (US)

(73) Assignee: North Carolina State University, Raleigh, NC (US)

( * ) Notice: Subject to any disclaimer, the term of this patent is extended or adjusted under 35 U.S.C. 154(b) by 340 days.

(21) Appl. No.: 11/062,665

(22) Filed: Feb. 22, 2005

(65) Prior Publication Data

US 2007/0003667 A1 Jan. 4, 2007

Related U.S. Application Data

(60) Provisional application No. 60/546,745, filed on Feb. 23, 2004.

(51) Int. Cl.
*C12P 21/06* (2006.01)
(52) U.S. Cl. .................. 435/69.1; 435/6; 435/69.1; 435/320.1; 435/252; 536/23.1
(58) Field of Classification Search ................ None
See application file for complete search history.

(56) References Cited

U.S. PATENT DOCUMENTS

| 5,837,509 | A | 11/1998 | Israelsen et al. |
| 6,451,584 | B2 | 9/2002 | Tomita et al. |
| 6,476,209 | B1 | 11/2002 | Glenn et al. |
| 6,544,772 | B1 | 4/2003 | Glenn et al. |
| 6,635,460 | B1 | 10/2003 | Van Hijum et al. |
| 2002/0159976 | A1 | 10/2002 | Glenn et al. |
| 2003/0138822 | A1 | 7/2003 | Glenn et al. |
| 2004/0009490 | A1 | 1/2004 | Glenn et al. |
| 2004/0208863 | A1 | 10/2004 | Versalovic et al. |
| 2005/0003510 | A1 | 1/2005 | Chang et al. |
| 2005/0112612 | A1 | 5/2005 | Klaenhammer |
| 2005/0123941 | A1 | 6/2005 | Klaenhammer |

FOREIGN PATENT DOCUMENTS

| EP | 633316 | * 11/1995 |
| EP | 0 888 118 B1 | 1/1999 |
| WO | WO 02/12506 A1 | 2/2002 |
| WO | WO 02/074798 A2 | 9/2002 |
| WO | WO 03/084989 A2 | 10/2003 |
| WO | WO 2004/020467 A2 | 3/2004 |
| WO | WO 2004/031389 A1 | 4/2004 |
| WO | WO 2004/069178 A2 | 8/2004 |
| WO | WO 2004/096992 A2 | 11/2004 |
| WO | WO 2005/001057 A2 | 1/2005 |
| WO | WO 2005/012491 A2 | 2/2005 |

OTHER PUBLICATIONS

Wells, Biochemistry, vol. 29, pp. 8509-8517, 1990.*
Seffernick et al. (J. Bacteriology, vol. 183, pp. 2405-2410, 2001.*
Kitazono, A., et al., "Prolyl Aminopeptidase Gene From *Flavobacterium meningosepticum*: Cloning, Purification of the Expressed Enzyme, and Analysis of Its Sequence," *Archives of Biochemistry and Biophysics*, 1996, pp. 35-41, vol. 336(1).

Joutsjoki, V. et al., "Recombinant Lactococcus Starters as A Potential Source of Additional Peptidolytic Activity in Cheese Ripening, *Journal of Applied Microbiology*," 2002, pp. 1159-1166, vol. 92.
Abee et al. (1994) "Kinetic studies of the action of lactacin F, a bacteriocin produced by *Lactobacillus johnsonii* that forms poration complexes in the cytoplasmic membrane" *Appl. Environ. Microbiol.* 60:1006-1013.
Allison and Klaenhammer (1996) "Functional analysis of the gene encoding immunity to lactacin F, *lafI*, and its use as a *Lactobacillus*-specific, food-grade genetic marker" *Appl. Environ. Microbiol.* 62:4450-4460.
Allison and Klaenhammer (1999) "Genetics of bacteriocins produced by lactic acid bacteria and their use in novel industrial applications" in *Manual of Industrial Microbiology and Biotechnology*. DeMain and Davies (eds.), ASM Press, Washington, D.C., pp. 789-808.
Allison et al. (1994) "Expansion of bacteriocin activity and host range upon complementation of two peptides encoded with the lactacin F operon" *J. Bacteriol.* 176:2235-2241.
Altermann et al. (2004) "Identification and phenotypic characterization of the cell-division protein CdpA" *Gene* 342:189-197.
Altermann et al. (2005) "Complete genome sequence of the probiotic lactic acid bacterium *Lactobacillus acidophilus* NCFM" *Proc. Natl. Acad. Sci. U.S.A.* Early Edition 10.1073/pnas.0409188102, online publication date Jan. 25, 2005.
Azcarate-Peril et al. (2004) "Identification and inactivation of genetic loci involved with *Lactobacillus acidophilus* acid tolerance" *Appl. Environ. Microbiol.* 70:5315-5322.
Barefoot and Klaenhammer (1983) "Detection and activity of lactacin B, a bacteriocin produced by *Lactobacillus acidophilus*" *Appl. Environ. Microbiol.* 45:1808-1815.
Barefoot and Klaenhammer (1984) "Purification and characterization of the *Lactobacillus acidophilus* bacteriocin lactacin B" *Antimicrob. Agents Chemother.* 26:328-334.
Barefoot et al. (1994) "Identification and purification of a protein that induces production of the *Lactobacillus acidophilus* bacteriocin lactacin B" *Appl. Environ. Microbiol.* 60:3522-3528.
Barrangou et al. (2003) "Functional and comparative genomic analyses of an operon involved in fructooligosaccharide utilization by *Lactobacillus acidophilus*" *Proc. Natl. Acad. Sci. U.S.A.* 100:8957-8962.
Boels et al. (2001) "Functional analysis of the *Lactococcus lactis galU* and *galE* genes and their impact on sugar nucleotide and exopolysaccharide biosynthesis" *Appl. Environ. Microbiol.* 67:3033-3040.
Bruno-Barcena et al. (2004) "Expression of heterologous manganese superoxide dismutase gene in intestinal lactobacilli provides protection against hydrogen peroxide toxicity" *Appl. Environ. Microbiol.* 70:4702-4710.

(Continued)

*Primary Examiner*—Hope A Robinson
(74) *Attorney, Agent, or Firm*—Alston & Bird LLP

(57) ABSTRACT

Protease-like nucleic acid molecules and polypeptides and fragments and variants thereof are disclosed in the current invention. In addition, protease-like fusion proteins, antigenic peptides, and anti-protease-like antibodies are encompassed. The invention also provides vectors containing a nucleic acid molecule of the invention and cells into which the vectors have been introduced. Methods for producing the polypeptides and methods of use for the polypeptides of the invention are further disclosed.

15 Claims, No Drawings

OTHER PUBLICATIONS

Christensen et al. (1999) "Peptidases and Amino Acid Catabolism in Lactic Acid Bacteria" *Antonie van Leeuwenhoek* 76:217-246.

Coconnier et al. (1992) "Protein-mediated adhesion of *Lactobacillus acidophilus* BG2FO4 on human enterocyte and mucus-secreting cell lines in culture" *Appl. Environ. Microbiol.* 58:2034-2039.

Contreras et al. (1997) "Isolation, purification and amino acid sequence of lactobin A, one of the two bacteriocins produced by *Lactobacillus amylovorus* LMG P-13139" *Appl. Environ. Microbiol.* 63:13-20.

De Vuyst and Degeest (1998) "Heteropolysaccharides from lactic acid bacteria" *FEMS Microbiol. Rev.* 23:153-177.

Dodd and Gasson (1994) "Bacteriocins of lactic acid bacteria" in *Genetics and Biotechnology of Lactic Acid Bacteria.* Gasson and de Vos (eds.), Blackie Academic and Professional, London, pp. 211-251.

Fremaux et al. (1993) "Molecular analysis of the lactacin F operon" *Appl. Environ. Microbiol.* 59:3906-3915.

Girgis et al. (2002) "Sress adaptations of lactic acid bacteria" in *Microbial adaptation to stress and safety of new-generation foods.* Yousef and Juneja (eds.) CRC Press, NY, pp. 159-212.

Greene and Klaenhammer (1994) "Factors involved in adherence of lactobacilli to human Caco-2 cells" *Appl: Environ. Microbiol.* 60:4487-4494.

Holzapfel et al. (2001) "Taxonomy and Important Features of Probiotic Microorganisms in Food and Nutrition" *Am J of Clin Nutr* 73 Suppl: 365S-373S.

Hugenholtz et al. (1999) "Metabolic Engineering of Lactic Acid Bacteria: Overview of the Approaches and Results of Pathway Rerouting Involved in Food Fermentations" *Current Opinion in Biotechnology* 10: 492-497.

Joerger and Klaenhammer (1986) "Characterization and purification of the helveticin J and evidence for a chromosomally determined bacteriocin produced by *Lactobacillus helveticus*" *J. Bacteriol.* 167:439-446.

Joerger et al. (1990) "Cloning, expression, and nucleotide sequence of the *Lactobacillus helveticus* 481 gene encoding the bactericin helveticin J" *J. Bacteriol.* 172:6339-6347.

Jolly et al. (2002) "Exploiting exopolysaccharides from lactic acid bacteria" *Antonie van Leeuwenhoek* 82:367-374.

Klaenhammer (1988) "Bacteriocins of lactic acid bacteria" *Biochimie* 70:337-349.

Klaenhammer (1993) "Genetics of bacteriocins produced by lactic acid bacteria" *FEMS Microbiol. Rev.* 12:39-85.

Klaenhammer (2000) "Probiotic bacteria: today and tomorrow" *J. Nutr.* 130(2S Suppl.): 415S-416S.

Klaenhammer and Kullen (1999) "Selection and design of probiotics" *Int. J. Food Microbiol.* 50:45-57.

Klaenhammer and Sutherland (1980) "Detection of plasmid deoxyribonucleic acid in an isolate of *Lactobacillus acidophilus*" *Appl. Environ. Microbiol.* 39:671-674.

Klaenhammer et al. (2002) "Discovering lactic acid bacteria by genomics" *Antonie van Leeuwenhoek* 82:29-58.

Kleeman and Klaenhammer (1982) "Adherence of *Lactobacillus* species to human fetal intestinal cells" *J. Dairy Sci.* 65:2063-2069.

Kleerebezem et al. (1999) "Exopolysaccharides produced by *Lactococcus lactis*: from genetic engineering to improved rheological properties?" *Antonie van Leeuwenhoek* 76:357-365.

Kleerebezem et al. (2003) "Complete genome sequence of *Lactobacillus plantarum* WCFSI" *Proc. Natl. Acad. Sci. U.S.A.* 100:1990-1995.

Kok et al. "The Proteolytic System of Lactic Acid Bacteria" *Genetics and Biotechnology of Lactic Acid Bacteria* pp. 169-210, M. Gasson and W.M. DeVos, Eds., Blackie and Professional, London, England (1994).

Konigs et al. (1997) "The role of transport processes in survival of lactic acid bacteria" *Antonie van Leeuwenhoek* 71:117-128.

Konigs et al. (2000) "Lactic acid bacteria: the bugs of the new millennium" *Curr. Opin. Microbiol.* 3:276-282.

Kuipers et al. (2000) "Current Strategies for Improving Food Bacteria" *Res Microbiol* 151:815-822.

Kullen and Klaenhammer (1999) Identification of the pH-inducible, proton-translocating $F_1F_0$-ATPase (atpBEFHAGDC) operon of *Lactobacillus acidophilus* by differential display: gene structure, cloning and characterization *Mol. Microbiol.* 33:1152-1161.

Kullen and Klaenhammer (2000) "Genetic modification of intestinal lactobacilli and bifidobacteria" *Curr. Issues Mol. Biol.* 2:41-50.

Kullen et al. (2000) "Use of the DNA sequence of variable regions of the 16S rRNA gene for rapid and accurate identification of bacteria in the *Lactobacillus acidophilus* complex" *J. Appl. Microbiol.* 89:511-516.

Law et al. (1997) "Proteolytic Enzymes of Lactic Acid Bacteria" *Int Dairy Journal* 7: 1-11.

Luchansky et al. (1988) "Application of electroporation for transfer of plasmid DNA to *Lactobacillus, Lactococcus, Leuconostoc, Listeria, Pediococcus, Bacillus, Staphylococcus, Enterococcus* and *Propionobacterium*" *Mol. Microbiol.* 2:637-646.

Luchansky et al. (1989) "Genetic transfer systems for delivery of plasmid deoxyribonucleic acid to *Lactobacillus acidophilus* ADH: conjugation, electroporation, and transduction" *J. Dairy Sci.* 72:1408-1417.

Luchansky et al. (1991) "Molecular cloning and deoxyribonucleic acid polymorphisms in *Lactobacillus acidophilus* and *Lactobacillus gasseri*" *J. Dairy Sci.* 74:3293-3302.

Majhenic et al. (2004) "DNA analysis of the genes encoding acidocin LF221 A and acidocin LF221 B, two bacteriocins produced by *Lactobacillus gasseri* LF221" *Appl. Microbiol. Biotechnol.* 63:705-714.

Mohamadzadeh et al. (2005) "Lactobacilli activate human dendritic cells that skew T cells toward T helper 1 polarization" *Proc. Nat. Acad. Sci. USA* 102:2880-2885.

Muriana and Klaenhammer (1991) "Cloning, phenotypic expression, and DNA sequence of the gene for lactacin F, an antimicrobial peptide produced by *Lactobacillus spp.*" *J. Bacteriol.* 173:1779-1788.

Muriana and Klaenhammer (1991) "Purification and partial characterization of lactacin F, a bacteriocin produced by *Lactobacillus acidophilus* 11088" *Appl. Environ. Microbiol.* 571:114-121.

Pao et al. (1998) "Major Facilitator Superfamily" *Microbiol. Mol. Biol. Rev.* 62:1-34.

Poolman (2002) "Transporters and their roles in LAB cell physiology" *Antonie van Leeuwenhoek* 82:147-164.

Pridmore et al. (2004) "The genome sequence of the probiotic intestinal bacterium *Lactobacillus johnsonii* NCC 533" *Proc. Natl. Acad. Sci. U.S.A.* 101:2512-2517.

Putman et al. (2000) "Molecular properties of bacterial multidrug transporters" *Microbiol. Mol. Biol. Rev.* 64:672-693.

Rastall et al. (2005). Modulation of the microbial ecology of the human colon by probiotics, prebiotics and synbiotics to enhance human health: An overview of enabling science and potential applications. *FEMS Microbiol. Ecol.* 52:145-152.

Roy et al. (1993) "Cloning and expression of the manganese superoxide dismutase gene of *Escherichi coli* in *Lactococcus lactis* and *Lactobacillus gasseri*" *Mol. Gen. Genet.* 239:33-40.

Russell and Klaenhammer (2001) "Efficient system for directed integration into the *Lactobacillus acidophilus* and *Lactobacillus gasseri* chromosomes via homologous recombination" *Appl. Environ. Microbiol.* 67:4361-4364.

Russell and Klaenhammer (2001) "Identification and cloning of gusA, encoding a new β-glucuronidase from *Lactobacillus gasseri* ADH" *Appl. Environ. Microbiol.* 67:1253-1261.

Sablon et al. (2000) "Antimicrobiol peptides of lactic acid bacteria: mode of action, genetics and biosynthesis" in *Advances in Biochemical Engineering/Biotechnology.* vol. 68. Schleper (ed.), Springer-Verlag, Berlin, pp. 21-60.

Sanders and Klaenhammer (2001) "Invited review: the scientific basis of *Lactobacillus acidophilus* NCFM functionality as a probiotic" *J. Dairy Sci.* 84:319-331.

Sanders et al. (1996) "Performance of commercial cultures in fluid milk applications" *J. Dairy Sci.* 79:943-955.

Steidler et al. (1998) "Functional display of a heterologous protein on the surface of *Lactococcus lactis* by means of the cell wall anchor of *Staphylococcus aureus* protein A" *Appl. Environ. Microbiol.* 64:342-345.

Sturino and Klaenhammer (2004) "Bacteriophage defense systems for lactic acid bacteria" *Adv. Appl. Microbiol.* 56:331-378.
Ventura et al. (2003) "Analysis, characterization, and loci of the *tuf* genes in *Lactobacillus and Bifidobacterium* species and their direct application for species identification" *Appl. Environ. Microbiol.* 69:6908-6922.
Walker et al. (1999) "The *groESL* chaperone operon of *Lactobacillus johnsonii*" *Appl. Environ. Microbiol.* 65:3033-3041.
Yother et al. (2002) Genetics of streptococci, lactococci, and enterococci: review of the sixth international conference *J. Bacteriol.* 184:6085-6092.
GenBank Accession No. AAB66326, filed Aug. 7, 1997; GroEL; Source: *Lactobacillus zeae*.
GenBank Accession No. AAC29003, filed Aug. 7, 1998; cochaperonin GroES; Source: *Lactobacillus helveticus*.
GenBank Accession No. AAC99363, filed Sep. 10, 1999; D-lactate dehydrogenase; Source: *Lactobacillus johnsonii*.
GenBank Accession No. AAF22492, filed Aug. 30, 2001; F1F0-ATPase subunit a; Source: *Lactobacillus acidophilus*.
GenBank Accession No. AAF22493, filed Aug. 30, 2001; F1F0-ATPase subunit c; Source: *Lactobacillus acidophilus*.
GenBank Accession No. AAF22494, filed Aug. 30, 2001; F1F0-ATPase subunit b; Source: *Lactobacillus acidophilus*.
GenBank Accession No. AAF22495, filed Aug. 30, 2001; F1F0-ATPase subunit delta; Source: *Lactobacillus acidophilus*.
GenBank Accession No. AAF22496, filed Aug. 30, 2001; F1F0-ATPase subunit alpha; Source: *Lactobacillus acidophilus*.
GenBank Accession No. AAF22497, filed Aug. 30, 2001; F1F0-ATPase subunit gamma; Source: *Lactobacillus acidophilus*.
GenBank Accession No. AAF22498, filed Aug. 30, 2001; F1F0-ATPase subunit beta; Source: *Lactobacillus acidophilus*.
GenBank Accession No. AAF22499, filed Aug. 30, 2001; F1F0-ATPase subunit epsilon; Source: *Lactobacillus acidophilus*.
GenBank Accession No. AAF75593, filed Jun. 13, 2000; GroEL; Source: *Lactobacillus johnsonii*.
GenBank Accession No. AAK97217, filed Sep. 2, 2001; cochaperonin GroES; Source: *Lactobacillus acidophilus*.
GenBank Accession No. AAK97218, filed Sep. 2, 2001; chaperonin GroEL; Source: *Lactobacillus acidophilus*.
GenBank Accession No. AAK97220, filed Sep. 2, 2001; cochaperonin GrpE; Source: *Lactobacillus acidophilus*.
GenBank Accession No. AAK97221, filed Sep. 2, 2001; Heat shock protein DnaK; Source: *Lactobacillus acidophilus*.
GenBank Accession No. AAR25444, filed Dec. 12, 2003; Tuf; *Lactobacillus johnsonii*.
GenBank Accession No. AAT09141, filed Sep. 7, 2004; amino aid permease La995; Source: *Lactobacillus acidophilus*.
GenBank Accession No. AF010281, filed Aug. 9, 1997; *Lactobacillus zeae* GroES; Source: *Lactobacillus zeae*.
GenBank Accession No. AF031929, filed Aug. 8, 1998; *Lactobacillus helveticus* cochaperonin GroES and chaperonin GroEL genes, complete cds and DNA mismatch repair enzyme (hexA) gene, partial cds; Source: *Lactobacillus helveticus*.
GenBank Accession No. AF071558, filed Sep. 10, 1999; *Lactobacillus johnsonii* D-lactate dehydrogenase (ldhD) gene, complete cds; Source: *Lactobacillus johnsonii*.
GenBank Accession No. AF098522, filed Aug. 30, 2001; *Lactobacillus acidophilus* uracil phosphoribosyltransferase; Source: *Lactobacillus acidophilus*.
GenBank Accession No. AF214488, filed Jun. 13, 2000; *Lactobacillus johnsonii* groESL operon, complete sequence and unknown gene; Source: *Lactobacillus johnsonii*.
GenBank Accession No. AF300645, filed Sep. 2, 2001; *Lactobacillus acidophilus* groESL operon, complete sequence; Source: *Lactobacillus acidophilus*.
GenBank Accession No. AF300646, filed Sep. 2, 2001; *Lactobacillus acidophilus* repressor protein HrcA (hrcA) gene, partial cds; cochaperonin GrpE (grpE) and heat shock protein DnaK (dnaK) genes, complete cds, and DnaJ (dnaJ) gene, partical cds; Source: *Lactobacilus acidophilus*.
GenBank Accession No. CAA42781, filed Nov. 5, 1992; D-lactate dehydrogenase; Source: *Lactobacillus delbrueckii*.
GenBank Accession No. CAA59019, filed Apr. 18, 2005; heat shock induced protein HtpI; Source: *Lactobacillus leichmannii*.
GenBank Accession No. CAA61561, filed Jan. 22, 1996; SB-protein: *Lactobacillus acidophilus*.
GenBank Accession No. NP_964658, filed Jan. 26, 2007; probable xylulose-5-phosphate/fructose-6-phosphate phosphoketolase; Source: *Lactobacillus johnsonii NCC 533*.
GenBank Accession No. NP_964694, filed Jan. 26, 2007; RecA protein; Source: *Lactobacillus johnsonii NCC 533*.
GenBank Accession No. NP_964728, filed Jan. 26, 2007; phosphoglycerate kinase; Source: *Lactobacillus johnsonii NCC 533*.
GenBank Accession No. NP_964948, filed Jan. 26, 2007; DNA-binding protein HU; Source: *Lactobacillus johnsonii NCC 533*.
GenBank Accession No. NP_965314, filed Jan. 26, 2007; 50S ribosomal protein L19; Source: *Lactobacillus johnsonii NCC 533*.
GenBank Accession No. NP_965472, filed Jan. 26, 2007; thioredoxin; Source: *Lactobacillus johnsonii NCC 533*.
GenBank Accession No. NP_965500, filed Jan. 26, 2007; hypothetical protein LJ1693; Source: *Lactobacillus johnsonii NCC 533*.
GenBank Accession No. O07684, filed Nov. 17, 2006; Beta-galactosidase large subunit; Source: *Lactobacillus acidophilus*.
GenBank Accession No. O07685, filed Nov. 28, 2006; Beta-galactosidase small subunit; Source: *Lactobacillus acidophilus*.
GenBank Accession No. O32755, filed Oct. 17, 2006; Glyceraldehyde-3-phosphate dehydrogenase; Source: *Lactobacillus delbrueckii* subsp. *Bulgaricus*.
GenBank Accession No. O32756, filed Apr. 18, 2006; Phosphoglycerate kinase; Source: *Lactobacillus delbrueckii* subsp. *Bulgaricus*.
GenBank Accession No. O32765, filed Nov. 28, 2006; L-lactate dehydrogenase; Source: *Lactobacillus helveticus*.
GenBank Accession No. O68324, filed Mar. 21, 2006; 60 kDa chaperonin; Source: *Lactobacillus helveticus*.
GenBank Accession No. P26297, filed Jan. 23, 2007; D-lactate dehydrogenase; Source: *Lactobacillus delbrueckii* subsp. *Bulgaricus*.
GenBank Accession No. P30901, filed Jan. 23, 2007; D-lactate dehydrogenase; Source: *Lactobacillus helveticus*.
GenBank Accession No. P34038, filed Nov. 28, 2006; Pyruvate Kinase; Source: *Lactobacillus delbrueckii* subsp. *Bulgaricus*.
GenBank Accession No. P35829, filed Jan. 9, 2007; S-layer protein precursor; Source: *Lactobacilus acidophilus*.
GenBank Accession No. P43451, filed Oct. 17, 2006; ATP synthase beta chain; Source: *Enterococcus hirae*.
GenBank Accession No. Q00052, filed Mar. 21, 2006; Galactokinase; Source: *Lactobacillus helveticus*.
GenBank Accession No. Q9Z4H7, filed Oct. 17, 2006; Serine protease do-like htrA; Source: *Lactobacillus helveticus*.
GenBank Accession No. X60220, filed Nov. 5, 1992; *L. delbrueckii* subsp. *Bulgaricus* 1dhA gene for D-lactate dehydrogenase; Source: *Lactobacillus delbrueckii*.
GenBank Accession No. X84261, filed Apr. 18, 2005; *L.leichmannii* xerC, hsIU and hsIV; Source: *Lactobacillus leichmannii*.
GenBank Accession No. X89376, filed Jan. 22, 1996; *L. acidophilus* DNA for SB-protein gene; Source: *Lactobacillus acidophilus*.
GenBank Accession No. ZP_00046537, filed May 25, 2006; COG0124: Histidyl-tRNA sythetase; Source: *Lactobacillus gasseri*.
GenBank Accession No. ZP_00046557, filed May 25, 2006; COG0148: Enolase; Source: *Lactobacillus gasseri*.
GenBank Accession No. ZP_00046583, filed May 25, 2006; COG0195: Transcription elongation factor; Source: *Lactobacillus gasseri*.
GenBank Accession No. ZP_00047305, filed May 25, 2006; COG04690: Dipeptidase; Source: *Lactobacillus gasseri*.
GenBank Accession No. ZP_00341831, filed May 25, 2006; COG0522: Ribosomal protein S4 and related proteins; Source: *Lactobacillus gasseri*.
GenBank Accession No. Q03234, filed Oct. 17, 2006; ATP synthesis beta chain;*Lactobacillus casei*.
GenBank Accession No. S47276, filed Jan. 6, 1995; Prolinase; *Lactobacillus helveticus*.
GenBank Accession No. S47274, filed Feb. 1, 1994; Membrane alanyl aminopeptidase; *Lactobacillus helveticus*.

GenBank Accession No. P94870, filed May 1, 1997; Aminopeptidase; *Lactobacillus helveticus*.

GenBank Accession No. O84913, filed Jul. 1, 1997; Xaa-Pro dipeptidase (X-Pro dipeptidase); *Lactobacillus helveticus*.

GenBank Accession No. Q10730, filed Oct. 1, 2006; Aminopeptidase N (Lysyl aminopeptidase); *Lactobacillus helveticus*.

GenBank Accession No. Q10744, filed Nov. 1, 1996; Aminopeptidase C (Bleomycin hydrolase); *Lactobacillus helviticus*.

GenBank Accession No. Q48558, filed Sep. 26, 2001; Dipeptidase A; *Lactobacillus helveticus*.

GenBank Accession No. AAA19050, filed Jan. 17, 1994; Prolinase; *Lactobacillus helveticus*.

GenBank Accession No. AAA25250, filed Jan. 13, 1994, Aminopeptidase C; *Lactobacillus helveticus*.

GenBank Accession No. AAB52540, filed Nov. 1, 1996, Endopeptidase; *Lactobacillus helveticus*.

GenBank Accession No. AAQ72431, filed Aug. 11, 2003, Endopeptidase E2; *Lactobacillus helveticus*.

GenBank Accession No. CAA86210, filed Oct. 10, 1994, Dipeptidase; *Lactobacillus helveticus*.

GenBank Accession No. CAB72938, filed Jun. 23, 1999, Tripeptidase enzyme; *Lactobacillus helveticus*.

GenBank Accession No. B59088, filed Oct. 22, 1999, Prolyl aminopeptidase; *Lactobacillus helveticus*.

* cited by examiner

US 7,455,992 B2

LACTOBACILLUS ACIDOPHILUS NUCLEIC ACID SEQUENCES ENCODING PROTEASE HOMOLOGUES AND USES THEREFORE

CROSS REFERENCE TO RELATED APPLICATIONS

This application claims the benefit of U.S. Provisional Application Ser. No. 60/546,745, filed Feb. 23, 2004, the contents of which are herein incorporated by reference in their entirety. Furthermore, the entire contents of the compact disk filed in duplicate herewith and containing one file entitled "5051.692 Sequence Listing" (603 kb; created Feb. 22, 2005) is incorporated by reference herein.

FIELD OF THE INVENTION

This invention relates to polynucleotides isolated from lactic acid bacteria, namely *Lactobacillus acidophilus*, and polypeptides encoded by them, as well as methods for using the polypeptides and microorganisms expressing them.

BACKGROUND OF THE INVENTION

*Lactobacillus acidophilus* is a Gram-positive, rod-shaped, non-spore forming, homofermentative bacterium that is a normal inhabitant of the gastrointestinal and genitourinary tracts. Since its' original isolation by Moro (1900) from infant feces, the "acid loving" organism has been found in the intestinal tract of humans, breast-fed infants, and persons consuming high milk, lactose, or dextrin diets. Historically, *L. acidophilus* is the *Lactobacillus* species most often implicated as an intestinal probiotic capable of eliciting beneficial effects on the microflora of the gastrointestinal tract (Klaenhammer and Russell (2000) "Species of the *Lactobacillus acidophilus* complex," *Encyclopedia of Food Microbiology*, Volume 2, pp. 1151-1157. Robinson et al. eds. (Academic Press, San Diego, Calif.). *L. acidophilus* can ferment hexoses, including lactose and more complex oligosaccharides, to produce lactic acid and lower the pH of the environment where the organism is cultured. Acidified environments (e.g., food, vagina, and regions within the gastrointestinal tract) can interfere with the growth of undesirable bacteria, pathogens, and yeasts. The organism is well known for its acid tolerance, survival in cultured dairy products, and viability during passage through the stomach and gastrointestinal tract. *Lactobacilli* and other commensal bacteria, some of which are considered as probiotic bacteria that favor life, have been studied extensively for their effects on human health, particularly in the prevention or treatment of enteric infections, diarrheal disease, prevention of cancer, and stimulation of the immune system. Genetic characterization of other *Lactobacillus* species (e.g., *L johnsonii* and *L. rhamnosus*) has been described (see e.g., U.S. Pat. No. 6,476,209; U.S. Pat. No. 6,544,772; U.S. Patent Publication Nos. 20020159976, 2003013882 & 20040009490; PCT Publication No. WO 2004/031389; PCT Publication No. 2003/084989; PCT Publication No. WO 2004/020467).

Lactic acid bacteria are widely used for the production of fermented milk products. Their requirement for an exogenous source of amino acids or peptides necessitates having an efficient proteolytic system that can degrade the casein in milk into the necessary small peptides and single amino acids used for growth. The peptides and amino acids generated through proteolysis are also involved in the development of texture and flavor in dairy products. Enzymes of the proteolytic system include a cell wall-bound extracellular proteinase (CEP), which is responsible for the initial breakdown of casein, and various intracellular peptidases, which further degrade the oligopeptides thus formed. In addition, there are proteins involved in amino acid transport systems for the uptake of peptides and amino acids from the environment, and enzymes involved in converting amino acids into flavor compounds.

There are two main types of CEPs, designated PI and PIII (Visser et al. (1986) *Appl. Environ. Microbiol.* 52:1162; Siezen (1999) *Antonie Van Leeuwenhoek* 76:139-55). The multi-domain, cell-envelope proteinases encoded by the genes prtB of *Lactobacillus delbrueckii* subsp. *bulgaricus*, prtH of *Lactobacillus helveticus*, prtP of *Lactococcus lactis*, scpA of *Streptococcus pyogenes* and csp of *Streptococcus agalactiae* have been compared using multiple sequence alignment, secondary structure prediction and database homology searching methods. This comparative analysis has led to the prediction of a number of different domains in these cell-envelope proteinases, and their homology, characteristics and putative function are described. These domains include, starting from the N-terminus, a pre-pro-domain for secretion and activation, a serine protease domain (with a smaller inserted domain), two large middle domains A and B of unknown but possibly regulatory function, a helical spacer domain, a hydrophilic cell-wall spacer or attachment domain, and a cell-wall anchor domain. Not all domains are present in each cell-envelope proteinase, suggesting that these multi-domain proteins are the result of gene shuffling and domain swapping during evolution.

The CEPs differ in their cleavage specificity toward caseins, with PI preferentially degrading β-casein, not α- or κ-casein, and PIII degrading α-, β-, and κ-caseins (Pritchard and Coolbear (1993) *FEMS Micro. Rev.* 12:179-206). Less bitterness was generated from casein degraded by a PIII-type proteinase than by a PI-type proteinase (Visser et al. (1983) *Neth. Milk Dairy J.* 17:169-175). The domains mapped from various lactic acid bacteria CEPs include the pre-pro-domain for secretion and activation, a serine protease or catalytic domain, two large middle domains A and B which are thought to have a regulatory and stabilizing function, a helical spacer domain, a hydrophilic cell wall spacer domain, and a cell wall anchor domain (Siezen (1999) *Antonie Leeuwenhoek* 76:139-155). The cell wall anchor contains an LPXTG (SEQ ID NO: 135) sequence that is cleaved after translocation, and the enzyme is thought to be covalently linked to the peptidoglycan layer. This anchor is not present in the CEPs of some *lactobacillus* species.

Peptidases include aminopeptidases, dipeptidases, proline-specific peptidases, tripeptidases, carboxypeptidases, and endopeptidases. The peptidases have overlapping substrate specificities, and three or more peptidases need to be disrupted simultaneously to observe an effect on growth rate in milk (Mierau et al. (1996) *J. Bacteriol.* 179:2794-2803). Aminopeptidases are capable of releasing single amino acid residues from oligopeptides, and are therefore important for flavor development in fermented milk products (Law and Haandrikman (1997) *Int. Dairy J.* 7:1-11). In cheese production, for example, it is thought that lysis of the starter bacteria releases peptidases into the curd, which then hydrolyze the casein-derived peptides into amino acids, resulting in enhanced flavor (Meijer et al. (1998) *Appl. Env. Micro.* 64:1950-1953).

Because of the roles peptidases play, peptidase gene sequences are needed for genetic modification of bacteria, particularly *Lactobacillus*.

BRIEF SUMMARY OF THE INVENTION

Compositions and methods for modifying *Lactobacillus* organisms are provided. Compositions of the invention include isolated nucleic acid molecules from *Lactobacillus acidophilus* encoding protease-like proteins, including proteinases and peptidases. Specifically, the present invention provides isolated nucleic acid molecules comprising, consisting essentially of and/or consisting of the nucleotide sequence found in SEQ ID NO:1, 3, 5, 7, 10, 12, 14, 16, 18, 20, 22, 24, 26, 28, 30, 32, 34, 36, 38, 40, 42, 44, 46, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133 and/or 146, and isolated nucleic acid molecules encoding the amino acid sequence found in SEQ ID NO:2, 4, 6, 8, 9, 11, 13, 15, 17, 19, 21, 23, 25, 27, 29, 31, 33, 35, 37, 39, 41, 43, 45, 47, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134 and/or 147. Also provided are isolated or recombinant polypeptides comprising, consisting essentially of and/or consisting of an amino acid sequence as set forth in SEQ ID NO:2, 4, 6, 8, 9, 11, 13, 15, 17, 19, 21, 23, 25, 27, 29, 31, 33, 35, 37, 39, 41, 43, 45, 47, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134 and/or 147, and/or encoded by a nucleic acid molecule described herein. Variant nucleic acid molecules and polypeptides sufficiently identical to the nucleotide and amino acid sequences set forth in the sequence listing are encompassed by the present invention. Additionally, fragments and sufficiently identical fragments of the nucleotide and amino acid sequences are encompassed. Nucleotide sequences that are complementary to a nucleotide sequence of the invention, or that hybridize to a sequence or its complement of the invention are also encompassed.

Compositions further include vectors and cells for recombinant expression of the nucleic acid molecules described herein, as well as transgenic microbial populations comprising the vectors of this invention. Also included in the invention are methods for the recombinant production of the polypeptides of the invention, and methods for their use. Further included are methods and kits for detecting the presence of a nucleic acid or polypeptide sequence of the invention in a sample, and antibodies that bind to a polypeptide of the invention.

The protease-like molecules of the present invention are useful in the selection and production of recombinant bacteria, particularly the production of bacteria with improved fermentative abilities. Such bacteria include, but are not limited to, those able to produce more, or improved, products for human or animal health, bacteria producing enhanced flavors, textures, or odors of fermented products, and bacteria that permit more efficient or more economic fermentation procedures.

The following embodiments are encompassed by the present invention:

1. An isolated nucleic acid molecule selected from the group consisting of:
   a) a nucleic acid molecule comprising a nucleotide sequence as set forth in SEQ ID NO:1, 3, 5, 7, 10, 12, 14, 16, 18, 20, 22, 24, 26, 28, 30, 32, 36, 38, 40, 42, 44, 46, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 146, or a complement thereof;
   b) a nucleic acid molecule comprising a nucleotide sequence having at least 90% sequence identity to a nucleotide sequence as set forth in SEQ ID NO:1, 3, 5, 7, 10, 12, 14, 16, 18, 20, 22, 24, 26, 28, 30, 32, 34, 36, 38, 40, 42, 44, 46, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 146, or a complement thereof;
   c) a nucleic acid molecule that encodes a polypeptide comprising an amino acid sequence as set forth in SEQ ID NO:2, 4, 6, 8, 9, 11, 13, 15, 17, 19, 21, 23, 25, 27, 29, 31, 33, 37, 39, 41, 43, 45, 47, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, or 147;
   d) a nucleic acid molecule comprising a nucleotide sequence that encodes a polypeptide having at least 90% amino acid sequence identity to an amino acid sequence as set forth in SEQ ID NO:2, 4, 6, 8, 9, 11, 13, 15, 17, 19, 21, 23, 25, 27, 29, 31, 33, 37, 39, 41, 43, 45, 47, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, or 147; and
   e) a nucleic acid molecule that hybridizes under stringent conditions to a nucleic acid molecule of (a)-(d).

2. A vector comprising the nucleic acid molecule of embodiment 1.

3. The vector of embodiment 2, further comprising a nucleic acid molecule encoding a heterologous polypeptide.

4. A cell that contains the vector of embodiment 2.

5. The cell of embodiment 4 that is a bacterial cell or a eukaryotic cell.

6. An isolated polypeptide selected from the group consisting of:
   a) a polypeptide comprising an amino acid sequence of SEQ ID NO: 2, 4, 6, 8, 9, 11, 13, 15, 17, 19, 21, 23, 25, 27, 29, 31, 33, 35, 37, 39, 41, 43, 45, 47, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134 or 147;
   b) a polypeptide comprising a fragment of an amino acid sequence of SEQ ID NO: 2, 4, 6, 8, 9, 11, 13, 15, 17, 19, 21, 23, 25, 27, 29, 31, 33, 35, 37, 39, 41, 43, 45, 47, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134 or 147; and,
   c) a polypeptide comprising an amino acid sequence having at least 90% sequence identity with an amino acid sequence of SEQ ID NO: 2, 4, 6, 8, 9, 11, 13, 15, 17, 19, 21, 23, 25, 27, 29, 31, 33, 35, 37, 39, 41, 43, 45, 47, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134 or 147.

7. The polypeptide of embodiment 6 further comprising a heterologous amino acid sequence.

8. An antibody that selectively binds to a polypeptide of embodiment 6.

9. A method for producing a polypeptide comprising culturing the host cell of embodiment 4 under conditions in which a nucleic acid molecule encoding the polypeptide is expressed, said polypeptide being selected from the group consisting of:

a) a polypeptide comprising an amino acid sequence of SEQ ID NO: 2, 4, 6, 8, 9, 11, 13, 15, 17, 19, 21, 23, 25, 27, 29, 31, 33, 35, 37, 39, 41, 43, 45, 47, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134 or 147;

b) a polypeptide comprising a fragment of an amino acid sequence of SEQ ID NO: 2, 4, 6, 8, 9, 11, 13, 15, 17, 19, 21, 23, 25, 27, 29, 31, 33, 35, 37, 39, 41, 43, 45, 47, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134 or 147;

c) a polypeptide comprising an amino acid sequence having at least 90% sequence identity with an amino acid sequence of SEQ ID NO: 2, 4, 6, 8, 9, 11, 13, 15, 17, 19, 21, 23, 25, 27, 29, 31, 33, 35, 37, 39, 41, 43, 45, 47, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134 or 147; and, d) a polypeptide encoded by a nucleotide sequence having at least 90% sequence identity to a nucleotide sequence of SEQ ID NO: 1, 3, 5, 7, 10, 12, 14, 16, 18, 20, 22, 24, 26, 28, 30, 32, 34, 36, 38, 40, 42, 44, 46, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133 or 146.

10. A method for detecting the presence of a polypeptide in a sample comprising contacting the sample with a compound that selectively binds to a polypeptide and determining whether the compound binds to the polypeptide in the sample; wherein said polypeptide is selected from the group consisting of:

a) a polypeptide encoded by a nucleic acid sequence of SEQ ID NO: 1, 3, 5, 7, 10, 12, 14, 16, 18, 20, 22, 24, 26, 28, 30, 32, 34, 36, 38, 40, 42, 44, 46, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133 or 146;

b) a polypeptide comprising a fragment of an amino acid sequence encoded by a nucleic acid sequence of SEQ ID NO: 1, 3, 5, 7, 10, 12, 14, 16, 18, 20, 22, 24, 26, 28, 30, 32, 34, 36, 38, 40, 42, 44, 46, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133 or 146;

c) a polypeptide encoded by a nucleotide sequence having at least 90% sequence identity to a nucleic acid sequence of SEQ ID NO: 1, 3, 5, 7, 10, 12, 14, 16, 18, 20, 22, 24, 26, 28, 30, 32, 34, 36, 38, 40, 42, 44, 46, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133 or 146; and, d) a polypeptide comprising an amino acid sequence having at least 90% sequence identity to an amino acid sequence of SEQ ID NO: 2, 4, 6, 8, 9, 11, 13, 15, 17, 19, 21, 23, 25, 27, 29, 31, 33, 35, 37, 39, 41, 43, 45, 47, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134 or 147.

11. The method of embodiment 10, wherein the compound that binds to the polypeptide is an antibody.

12. A kit comprising a compound for use in the method of embodiment 10 and instructions for use.

13. A method for detecting the presence of a nucleic acid molecule of embodiment 1 in a sample, comprising the steps of:

a) contacting the sample with a nucleic acid probe or primer that selectively hybridizes to the nucleic acid molecule; and, b) determining whether the nucleic acid probe or primer binds to a nucleic acid molecule in the sample.

14. The method of embodiment 13, wherein the sample comprises mRNA molecules and is contacted with a nucleic acid probe.

15. A kit comprising a compound that selectively hybridizes to a nucleic acid molecule of embodiment 1, and instructions for use.

16. A method for modulating the growth rate of a bacterium comprising introducing into said organism a vector comprising at least one nucleotide sequence selected from the group consisting of:

a) a nucleotide sequence of SEQ ID NO:1, 3, 5, 7, 10, 12, 14, 16, 18, 20, 22, 24, 26, 28, 30, 32, 34, 36, 38, 40, 42, 44, 46, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133 or 146;

b) a nucleotide sequence comprising a fragment of a nucleotide sequence of SEQ ID NO:1, 3, 5, 7, 10, 12, 14, 16, 18, 20, 22, 24, 26, 28, 30, 32, 34, 36, 38, 40, 42, 44, 46, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133 or 146, wherein said fragment encodes a polypeptide that retains activity;

c) a nucleotide sequence that is at least 90% identical to the nucleotide sequence of SEQ ID NO:1, 3, 5, 7, 10, 12, 14, 16, 18, 20, 22, 24, 26, 28, 30, 32, 34, 36, 38, 40, 42, 44, 46, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133 or 146, wherein said nucleotide sequence encodes a polypeptide that retains activity; and, d) a nucleotide sequence encoding a polypeptide comprising an amino acid sequence having at least 90% sequence identity to an amino acid sequence of SEQ ID NO:2, 4, 6, 8, 9, 11, 13, 15, 17, 19, 21, 23, 25, 27, 29, 31, 33, 35, 37, 39, 41, 43, 45, 47, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134 or 147, wherein said polypeptide retains activity; and measuring the growth rate of said bacterium.

17. A method for modulating the acidification rate of a milk product fermented by lactic acid bacteria comprising introducing into said organism a vector comprising at least one nucleotide sequence selected from the group consisting of:

a) a nucleotide sequence of SEQ ID NO: 1, 3, 5, 7, 10, 12, 14, 16, 18, 20, 22, 24, 26, 28, 30, 32, 34, 36, 38, 40, 42, 44, 46, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133 or 146;

b) a nucleotide sequence comprising a fragment of a nucleotide sequence of SEQ ID NO: 1, 3, 5, 7, 10, 12, 14, 16, 18, 20, 22, 24, 26, 28, 30, 32, 34, 36, 38, 40, 42, 44, 46, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133 or 146, wherein said fragment encodes a polypeptide that retains activity;
c) a nucleotide sequence that is at least 90% identical to the sequence of SEQ ID NO: 1, 3, 5, 7, 10, 12, 14, 16, 18, 20, 22, 24, 26, 28, 30, 32, 34, 36, 38, 40, 42, 44, 46, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133 or 146, wherein said nucleotide sequence encodes a polypeptide that retains activity; and,
d) a nucleotide sequence encoding a polypeptide comprising an amino acid sequence having at least 90% sequence identity to an amino acid sequence of SEQ ID NO: 2, 4, 6, 8, 9, 11, 13, 15, 17, 19, 21, 23, 25, 27, 29, 31, 33, 35, 37, 39, 41, 43, 45, 47, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132 134 or 147, wherein said polypeptide retains activity; and measuring the acidification rate of said milk product.

18. A method for modifying the cleavage specificity of a *Lactobacillus acidophilus* protease comprising:
a) constructing a plasmid comprising a hybrid protease containing fragments of protease genes from more than one species of lactic acid bacteria, at least one of which is a nucleotide sequence from *Lactobacillus acidophilus* that encodes an amino acid sequence as found in SEQ ID NO: 2, 4, 6, 8, 9, 11, 13, 15, 17, 19, 21, 23, 25, 27, 29, 31, 33, 35, 37, 39, 41, 43, 45, 47, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134 or 147;
b) introducing said hybrid protease into a bacterial cell; and,
c) determining the cleavage specificity of said hybrid protease, wherein the specificity of the hybrid protease differs from a wild-type *Lactobacillus acidophilus* protease.

19. A method for modifying the substrate cleavage rate of a *Lactobacillus acidophilus* protease comprising:
a) constructing a plasmid comprising a hybrid protease enzyme containing fragments of protease genes from more than one species of lactic acid bacteria, at least one of which is a nucleotide sequence from *Lactobacillus acidophilus* that encodes an amino acid sequence as found in SEQ ID NO: 2, 4, 6, 8, 9, 11, 13, 15, 17, 19, 21, 23, 25, 27, 29, 31, 33, 35, 37, 39, 41, 43, 45, 47, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134 or 147;
b) introducing the hybrid protease into a bacterial cell; and,
c) determining the substrate cleavage rate of the hybrid enzyme, wherein the substrate cleavage rate of the hybrid enzyme is different than the wild-type protease.

20. A method for modifying the cleavage specificity of a *Lactobacillus acidophilus* protease comprising mutating a wild-type *Lactobacillus acidophilus* protease to create a mutein with a different cleavage specificity from said wild-type protease wherein said protease has an amino acid sequence as found in SEQ ID NO: 2, 4, 6, 8, 9, 11, 13, 15, 17, 19, 21, 23, 25, 27, 29, 31, 33, 35, 37, 39, 41, 43, 45, 47, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134 or 147.

21. The method of embodiment 20, wherein the method used to mutate said wild type protease is site-directed mutagenesis.

22. The method of embodiment 20, wherein the method used to mutate said wild-type protease is domain knockout.

23. A mutein of a *Lactobacillus acodiphilus* with an amino acid sequence having at least 90% sequence identity to SEQ ID NO: 2, 4, 6, 8, 9, 11, 13, 15, 17, 19, 21, 23, 25, 27, 29, 31, 33, 35, 37, 39, 41, 43, 45, 47, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134 or 147, and wherein said mutein has an altered cleavage specificity.

24. A method for modifying the cleavage rate of a *Lactobacillus acidophilus* protease comprising mutating a wild-type *Lactobacillus acidophilus* protease to create a mutein with a different cleavage rate from said wild-type protease, wherein said protease has an amino acid sequence as found in SEQ ID NO: 2, 4, 6, 8, 9, 11, 13, 15, 17, 19, 21, 23, 25, 27, 29, 31, 33, 35, 37, 39, 41, 43, 45, 47, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134 or 147.

25. The method of embodiment 24, wherein the method used to mutate said wild-type protease is site-directed mutagenesis.

26. The method of embodiment 24, wherein the method used to mutate said wild-type protease is domain knockout.

27. A mutein of a *Lactobacillus acidophilus* protease with an amino acid sequence having at least 90% sequence identity to SEQ ID NO: 2, 4, 6, 8, 9, 11, 13, 15, 17, 19, 21, 23, 25, 27, 29, 31, 33, 35, 37, 39, 41, 43, 45, 47, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134 or 147, wherein said mutein has an altered cleavage rate.

28. A method for modulating the rate of cheese ripening comprising fermenting milk used for cheese in the presence of a mutein of embodiment 27, wherein said mutein has an increased cleavage rate compared to a wild-type *Lactobacillus acidophilus* protease.

29. A method for modulating flavor diversification of fermented milk products comprising:
a) modifying a *Lactobacillus acidophilus* protease having an amino acid sequence found in SEQ ID NO: 2, 4, 6, 8, 9, 11, 13, 15, 17, 19, 21, 23, 25, 27, 29, 31, 33, 35, 37, 39, 41, 43, 45, 47, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134 or 147, such that the flavor of said products is different from the flavor of products produced by said wild-type *Lactobacillus acidophilus* protease;
b) introducing said modified protease into a host cell; and
c) fermenting milk used for cheese with said host cell.

30. A method for enhancing the stability of a *Lactobacillus acidophilus* protease comprising mutating a wild-type *Lactobacillus acidophilus* protease having an amino acid sequence found in SEQ ID NO: 2, 4, 6, 8, 9, 11, 13, 15, 17, 19, 21, 23, 25, 27, 29, 31, 33, 35, 37, 39, 41, 43, 45, 47, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134 or 147 to create a mutein with an enhanced stability compared to said wild-type protease.

31. A method for modifying the functional properties of a bacterial cell, comprising:
   a) transforming said bacterial cell with a vector comprising a fusion protein comprising a *Lactobacillus acidophilus* cell wall-bound proteinase having a nucleotide sequence encoding an amino acid sequence as found in SEQ ID NO: 2, 4, 6, 8, 9, 11, 13, 15, 17, 19, 21, 23, 25, 27, 29, 31, 33, 35, 37, 39, 41, 43, 45, 47, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134 or 147, operably linked to a heterologous protein or fragment; and
   b) culturing said bacterial cell under conditions that allow for expression of the fusion protein,
wherein the heterologous protein or fragment is expressed on the surface of said bacteria and provides a function that is not present in a wild-type bacteria.

32. The method of embodiment 31, wherein the heterologous protein or fragment thereof is an antibody.

33. The method of embodiment 31, wherein the heterologous protein or fragment thereof is an enzyme.

34. The method of embodiment 31, wherein the heterologous protein or fragment thereof is a vaccine antigen.

35. The method of embodiment 31, wherein the heterologous protein or fragment thereof has a bactericidal activity.

36. The method of embodiment 31, wherein the heterologous protein or fragment thereof has receptor-binding activity.

37. A method for modulating a host immune response after ingesting *L. acidophilus* products, comprising:
   a) modifying a wild-type *Lactobacillus acidophilus* protease having an amino acid sequence as found in SEQ ID NO: 2, 4, 6, 8, 9, 11, 13, 15, 17, 19, 21, 23, 25, 27, 29, 31, 33, 35, 37, 39, 41, 43, 45, 47, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134 or 147, such that the immune response to said protease is different from the immune response to a protease produced by said wild-type *Lactobacillus acidophilus*;
   b) introducing said modified protease into host cells; and
   c) feeding said host cells to a host organism.

38. A *Lactobacillus acidophilus* bacterial strain with an increased growth rate compared to a wild-type *Lactobacillus acidophilus*, wherein said increased growth rate is due to overexpression of at least one protease, wherein said protease has an amino acid sequence as found in SEQ ID NO: 2, 4, 6, 8, 9, 11, 13, 15, 17, 19, 21, 23, 25, 27, 29, 31, 33, 35, 37, 39, 41, 43, 45, 47, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134 or 147.

39. A *Lactobacillus acidophilus* bacterial strain having an increased acidification rate for a milk product fermented by a lactic acid bacteria, wherein said increased acidification rate is due to overexpression of at least one protease, wherein said protease has an amino acid sequence as found in SEQ ID NO: 2, 4, 6, 8, 9, 11, 13, 15, 17, 19, 21, 23, 25, 27, 29, 31, 33, 35, 37, 39, 41, 43, 45, 47, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134 or 147.

40. A *Lactobacillus acidophilus* bacterial strain comprising a protease with a modified cleavage specificity, wherein said strain contains at least one mutation in the nucleotide sequence encoding said protease, wherein said protease has an amino acid sequence as found in SEQ ID NO: 2, 4, 6, 8, 9, 11, 13, 15, 17, 19, 21, 23, 25, 27, 29, 31, 33, 35, 37, 39, 41, 43, 45, 47, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134 or 147.

41. A *Lactobacillus acidophilus* bacterial strain comprising a protease with a modified substrate cleavage rate, wherein said strain contains at least one mutation in the nucleotide sequence encoding said protease, wherein said protease has an amino acid sequence as found in SEQ ID NO: 2, 4, 6, 8, 9, 11, 13, 15, 17, 19, 21, 23, 25, 27, 29, 31, 33, 35, 37, 39, 41, 43, 45, 47, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134 or 147.

42. A *Lactobacillus acidophilus* bacterial strain having a modified rate of cheese ripening, wherein said strain contains at least one mutation in the nucleotide sequence encoding said protease, wherein said protease has an amino acid sequence as found in SEQ ID NO: 2, 4, 6, 8, 9, 11, 13, 15, 17, 19, 21, 23, 25, 27, 29, 31, 33, 35, 37, 39, 41, 43, 45, 47, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134 or 147.

43. A *Lactobacillus acidophilus* bacterial strain having increased flavor diversification, wherein said strain contains at least one mutation in the nucleotide sequence encoding said protease, wherein said protease has an amino acid sequence as found in SEQ ID NO: 2, 4, 6, 8, 9, 11, 13, 15, 17, 19, 21, 23, 25, 27, 29, 31, 33, 35, 37, 39, 41, 43, 45, 47, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134 or 147.

44. A *Lactobacillus acidophilus* bacterial strain having a mutein of a wild-type protease, wherein said mutein has enhanced stability compared to said wild-type protease, wherein said protease has an amino acid sequence as found in SEQ ID NO: 2, 4, 6, 8, 9, 11, 13, 15, 17, 19, 21, 23, 25, 27, 29, 31, 33, 35, 37, 39, 41, 43, 45, 47, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134 or 147.

45. A *Lactobacillus acidophilus* bacterial strain with modified functional properties, wherein said strain comprises a protease fusion protein, wherein said fusion protein provides a functional property not present in a wild-type *Lactobacillus acidophilus* strain, wherein said protease has an amino acid sequence as found in SEQ ID NO:2, 4, 6, 8, 9, 11, 13, 15, 17, 19, 21, 23, 25, 27, 29, 31, 33, 35, 37, 39, 41, 43, 45, 47, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134 or 147.

46. The strain of embodiment 44, wherein the fusion protein comprises an antibody.

47. The strain of embodiment 44, wherein the fusion protein comprises an enzyme.

48. The strain of embodiment 44, wherein the fusion protein comprises a vaccine antigen.

49. The strain of embodiment 44, wherein the fusion protein comprises a protein or fragment with bactericidal activity.

50. The strain of embodiment 44, wherein the fusion protein comprises a protein or fragment with receptor-binding activity.

DETAILED DESCRIPTION OF THE INVENTION

The present invention relates to protease-like molecules from *Lactobacillus acidophilus*. Nucleotide and amino acid sequences of the protease-like molecules are provided. The sequences are useful for modifying organisms for enhanced properties.

As used herein, "a," "an" and "the" can be plural or singular as used throughout the specification and claims. For example "a" cell can mean a single cell or a multiplicity of cells.

Also as used herein, "and/or" refers to and encompasses any and all possible combinations of one or more of the associated listed items, as well as the lack of combinations when interpreted in the alternative ("or").

By "protease-like molecules" or "protease" is intended an enzyme that catalyzes the splitting of proteins into smaller peptide fractions and amino acids by cleavage of their peptide bonds. The protease-like molecules include proteinases as well as peptidases. See Tables 1 and 2 for examples, and Table 3 for specific sequences of the invention. The full-length gene sequences or fragments thereof are referred to as protease-like sequences, showing that they have similarity to protease genes. The invention further provides fragments and variants of these protease-like sequences, which can be used to practice the methods of the present invention.

As used herein, the terms "gene" and "recombinant gene" refer to nucleic acid molecules comprising an open reading frame particularly those encoding a protease-like protein. Isolated nucleic acid molecules of the present invention comprise nucleic acid sequences encoding protease-like proteins, nucleic acid sequences encoding the amino acid sequences set forth in SEQ ID NOS:2, 4, 6, 8, 9, 11, 13, 15, 17, 19, 21, 23, 25, 27, 29, 31, 33, 35, 37, 39, 41, 43, 45, 47, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, and/or 147; the nucleic acid sequences set forth in SEQ ID NOS:1, 3, 5, 7, 10, 12, 14, 16, 18, 20, 22, 24, 26, 28, 30, 32, 34, 36, 38, 40, 42, 44, 46, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, and/or 146, and variants and fragments thereof. The present invention also encompasses antisense nucleic acid molecules, as described below.

In addition, isolated polypeptides and proteins having protease-like activity, and variants and fragments thereof, are encompassed, as well as methods for producing those polypeptides. For purposes of the present invention, the terms "protein" and "polypeptide" are used interchangeably. The polypeptides of the present invention have protease-like activity. Protease-like activity refers to a biological or functional activity as determined in vivo or in vitro according to standard assay techniques. In one embodiment, the activity is catalyzing the splitting of proteins into smaller peptide fractions and amino acids by cleavage of their peptide bonds. Protease-like activity encompasses the activity of peptidases, including endopeptidases and exopeptidases, and proteinases.

Peptidases are enzymes that break the peptide bonds linking the amino group of one amino acid with the carboxy group (acid group) of an adjacent amino acid in a peptide chain. The two main families of peptidases are endopeptidases and exopeptidases. Exopeptidases cleave amino acids from the N- or C-terminus of a peptide chain, releasing free amino acids or short (di- and tripeptides). Types of exopeptidases include aminopeptidases, which release a free amino acid from the N-terminus of a peptide chain, dipeptidyl-peptidases, which release a dipeptide from the N-terminus of a peptide chain, tripeptidyl-peptidases, which release a tripeptide from the N-terminus of a peptide chain, carboxypeptidases, which release a free amino acid from the C-terminus of a peptide chain, peptidyl-dipeptidases, which release a dipeptide from the C-terminus of a peptide chain, dipeptidases, which release two free amino acids from a dipeptide, and tripeptidases, which release a free amino acid and a dipeptide from a tripeptide. Specific exopeptidases of the present invention can be found in SEQ ID NOS:2, 6, 8, 13, 15, 25, 27, 29, 31, 37, 43, 45, 50, 54, 58, 60, 62, 66, 72, 98, 104, 120, and 126.

Endopeptidases hydrolyze internal peptide bonds and are classified on the basis of their mode of catalysis. They include serine-endopeptidases, which depend on serine (or threonine) as the nucleophile in the catalytic reaction, cysteine-endopeptidases, which depend on the sulfhydryl group of cysteine as the nucleophile in the catalytic reaction, aspartic-endopeptidases, which contain aspartate residues that act as ligands for an activated water molecule which acts as the nucleophile in the catalytic reaction, and metallo-endopeptidases, which contain one or more divalent metal ions that activate the water molecule that acts as the nucleophile in the catalytic reaction. Specific endopeptidases of the present invention include SEQ ID NOS:4, 21, 23, 33, 39, 64, 86, 100, and 116.

The nucleic acid and protein compositions encompassed by the present invention are isolated or substantially purified. By "isolated" or "substantially purified" is intended that the nucleic acid or protein molecules, or biologically active fragments or variants, are substantially or essentially free from components normally found in association with the nucleic acid or protein in its natural state. Such components include other cellular material, culture media from recombinant production, and various chemicals used in chemically synthesizing the proteins or nucleic acids. Preferably, an "isolated" nucleic acid of the present invention is free of nucleic acid sequences that flank the nucleic acid of interest in the genomic DNA of the organism from which the nucleic acid was derived (such as coding sequences present at the 5' or 3' ends). However, the molecule may include some additional bases or moieties that do not deleteriously affect the basic characteristics of the composition. For example, in various embodiments, the isolated nucleic acid contains less than 5 kb, 4 kb, 3 kb, 2 kb, 1 kb, 0.5 kb, or 0.1 kb of nucleic acid sequence normally associated with the genomic DNA in the cells from which it was derived. Similarly, a substantially purified protein has less than about 30%, 20%, 10%, 5%, or 1% (by dry weight) of contaminating protein, or non-protease-like protein. When the protein is recombinantly produced, preferably culture medium represents less than 30%, 20%, 10%, or 5% of the volume of the protein preparation, and when the protein is produced chemically, preferably the preparations have less than about 30%, 20%, 10%, or 5% (by dry weight) of chemical precursors, or non-protease-like chemicals.

The compositions and methods of the present invention can be used to modulate the function of the protease-like molecules of *L. acidophilus*. By "modulate," "alter," or "modify" is intended the up- or down-regulation of a target activity. Proteins of the invention are useful in modifying the abilities of lactic acid bacteria, and also in modifying the nutritional or health-promoting characteristics of foods fermented by such bacteria. Nucleotide molecules of the invention are useful in modulating protease-like protein expression by lactic acid bacteria. Up- or downregulation of expression from a polynucleotide of the present invention is encompassed. Upregulation may be accomplished by providing multiple gene copies, modulating expression by modifying regulatory elements, promoting transcriptional or translational mechanisms, or other means. Overexpression is one form of upregulation. Downregulation may be accomplished by using known antisense and gene silencing techniques.

By "lactic acid bacteria" is intended bacteria from a genus selected from the following: *Aerococcus, Carnobacterium, Enterococcus, Lactococcus, Lactobacillus, Leuconostoc, Oenococcus, Pediococcus, Streptococcus, Melissococcus, Alloiococcus, Dolosigranulum, Lactosphaera, Tetragenococcus, Vagococcus*, and *Weissella* (Holzapfel et al. (2001) *Am. J. Clin. Nutr.* 73:365S-373S; *Bergey's Manual of Systematic Bacteriology*, Vol. 2 (Williams and Wilkins, Baltimore; 1986) pp. 1075-1079).

The polypeptides of the present invention or microbes expressing them are useful as nutritional additives or supplements, and as additives in dairy and fermentation processing. The polynucleotide sequences, encoded polypeptides, and microorganisms expressing them are useful in the manufacture of milk-derived products, such as cheeses, yogurt, fermented milk products, sour milks, and buttermilk. Other food products that may be produced by bacteria expressing a polypeptide of the present invention are ice creams, fermented cereal based products, milk based powders, infant formulae, tablets, liquid bacterial suspensions, dried oral supplements, and liquid oral supplements. Microorganisms that express polypeptides of the invention may be probiotic organisms. By "probiotic" is intended a live microorganism that survives passage through the gastrointestinal tract and has a beneficial effect on the subject. By "subject" is intended an organism that comes into contact with a microorganism expressing a protein of the present invention. Subject may refer to humans and other animals.

The polynucleotides and polypeptides of the present invention are useful in modifying milk-derived products. These uses include, but are not limited to, modulating the growth rate of a bacterium, modulating the acidification rate of a milk product fermented by lactic acid bacteria, modulating the protease cleavage specificity or rate, modulating the rate of cheese ripening, modulating flavor diversification of fermented milk products, enhancing the stability of a protease, and modifying the functional properties of a bacterial cell.

In addition to the protease-like nucleotide sequences disclosed herein, and fragments and variants thereof, the isolated nucleic acid molecules of the current invention also encompass homologous DNA sequences identified and isolated from other organisms or cells by hybridization with entire or partial sequences obtained from the protease-like nucleotide sequences disclosed herein, or variants and fragments thereof.

Fragments and Variants

The invention provides isolated nucleic acid molecules comprising nucleotide sequences encoding protease-like proteins, as well as the protease-like proteins encoded thereby. By "protease-like protein" is intended proteins having the amino acid sequences set forth in SEQ ID NOS:2, 4, 6, 8, 9, 11, 13, 15, 17, 19, 21, 23, 25, 27, 29, 31, 33, 35, 37, 39, 41, 43, 45, 47, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, and 147. Fragments and variants of these nucleotide sequences and encoded proteins are also provided. By "fragment" of a nucleotide sequence or protein is intended a portion of the nucleotide or amino acid sequence.

Fragments of the nucleic acid molecules disclosed herein can be used as hybridization probes to identify protease-like-encoding nucleic acids, or can be used as primers in PCR amplification or mutation of protease-like nucleic acid molecules. Fragments of nucleic acids can also be bound to a physical substrate to comprise what may be considered a macro- or microarray (for example, U.S. Pat. No. 5,837,832; U.S. Pat. No. 5,861,242; WO 89/10977; WO 89/11548; WO 93/17126; U.S. Pat. No. 6,309,823). Such arrays or "chips" of nucleic acids may be used to study gene expression or to identify nucleic acid molecules with sufficient identity to the target sequences.

The present invention further provides a nucleic acid array or chip, i.e., a multitude of nucleic acids (e.g., DNA) as molecular probes precisely organized or arrayed on a solid support, which allow for the sequencing of genes, the study of mutations contained therein and/or the analysis of the expression of genes, as such arrays and chips are currently of interest given their very small size and their high capacity in terms of number of analyses.

The function of these nucleic acid arrays/chips is based on molecular probes, mainly oligonucleotides, which are attached to a carrier having a size of generally a few square centimeters or more, as desired. For an analysis, the carrier, such as in a DNA array/chip, is coated with DNA probes (e.g., oligonucleotides) that are arranged at a predetermined location or position on the carrier. A sample containing a target nucleic acid and/or fragments thereof to be analyzed, for example DNA or RNA or cDNA, that has been labeled beforehand, is contacted with the DNA array/chip leading to the formation, through hybridization, of a duplex. After a washing step, analysis of the surface of the chip allows any hybridizations to be located by means of the signals emitted by the labeled target. A hybridization fingerprint results, which, by computer processing, allows retrieval of information such as the expression of genes, the presence of specific fragments in the sample, the determination of sequences and/or the identification of mutations.

In one embodiment of this invention, hybridization between target nucleic acids and nucleic acids of the invention, used in the form of probes and deposited or synthesized in situ on a DNA chip/array, can be determined by means of fluorescence, radioactivity, electronic detection or the like, as are well known in the art.

In another embodiment, the nucleotide sequences of the invention can be used in the form of a DNA array/chip to carry out analyses of the expression of *Lactobacillus acidophilus* genes. This analysis is based on DNA array/chips on which probes, chosen for their specificity to characterize a given gene or nucleotide sequence, are present. The target sequences to be analyzed are labeled before being hybridized onto the chip. After washing, the labeled complexes are detected and quantified, with the hybridizations being carried out at least in duplicate. Comparative analyses of the signal intensities obtained with respect to the same probe for different samples and/or for different probes with the same sample, allows, for example, for differential transcription of RNA derived from the sample.

In yet another embodiment, arrays/chips containing nucleotide sequences of the invention can comprise nucleotide sequences specific for other microorganisms, which allows for serial testing and rapid identification of the presence of a microorganism in a sample.

In a further embodiment, the principle of the DNA array/chip can also be used to produce protein arrays/chips on which the support has been coated with a polypeptide and/or an antibody of this invention, or arrays thereof, in place of the nucleic acid. These protein arrays/chips make it possible, for example, to analyze the biomolecular interactions induced by the affinity capture of targets onto a support coated, e.g., with proteins, by surface plasma resonance (SPR). The polypeptides or antibodies of this invention, capable of specifically binding antibodies or polypeptides derived from the sample to be analyzed, can be used in protein arrays/chips for the detection and/or identification of proteins and/or peptides in a sample.

Thus, the present invention provides a microarray or microchip comprising various nucleic acids of this invention in any combination, including repeats, as well as a microarray comprising various polypeptides of this invention in any combination, including repeats. Also provided is a microarray comprising antibodies that specifically react with various polypeptides of this invention, in any combination, including repeats.

By "nucleic acid molecule" is intended DNA molecules (e.g., cDNA or genomic DNA) and RNA molecules (e.g., mRNA) and analogs of the DNA or RNA generated using nucleotide analogs. The nucleic acid molecule can be single-stranded or double-stranded, but preferably is double-stranded DNA. A fragment of a nucleic acid molecule encoding a protease-like protein may encode a protein fragment that is biologically active, or it may be used as a hybridization probe or PCR primer as described below. A biologically active fragment of a polypeptide disclosed herein can be prepared by isolating a portion of one of the nucleotide sequences of the invention, expressing the encoded portion of the protease-like protein (e.g., by recombinant expression in vitro), and assessing the activity of the encoded portion of the protease-like protein. Fragments of nucleic acid molecules encoding protease-like nucleic acid molecules comprise at least about 15, 20, 50, 75, 100, 200, 250, 300, 350, 400, 450, 500, 550, 600, 650, 700, 800, 900, 1000, 1500, 2000, 2500, 3000, 3500, 4000, or 4500 nucleotides or up to the total number of nucleotides present in a full-length protease-like nucleotide sequence as disclosed herein (for example, 879 for SEQ ID NO: 1, 1974 for SEQ ID NO: 3, etc.).

Fragments of amino acid sequences include polypeptide fragments suitable for use as immunogens to raise anti-protease-like antibodies. Fragments include peptides comprising amino acid sequences sufficiently identical to or derived from the amino acid sequence of a protease-like protein, or partial-length protein, of the invention and exhibiting at least one activity of a protease-like protein, but which include fewer amino acids than the full-length protease-like proteins disclosed herein. Typically, biologically active portions comprise a domain or motif with at least one activity of the protease-like protein. A biologically active portion of a protease-like protein can be a polypeptide that is, for example, 10, 25, 50, 100, 150, 200 contiguous amino acids in length, or up to the total number of amino acids present in a full-length protease-like protein of the current invention (for example, 293 for SEQ ID NO: 2, 658 for SEQ ID NO: 4, etc.). Such biologically active portions can be prepared by recombinant techniques and evaluated for one or more of the functional activities of a native protease-like protein. As used here, a fragment comprises at least 5 contiguous amino acids of any of SEQ ID NOS:2, 4, 6, 8, 9, 11, 13, 15, 17, 19, 21, 23, 25, 27, 29, 31, 33, 35, 37, 39, 41, 43, 45, 47, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, and 147. The invention encompasses other fragments, however, such as any fragment in the protein greater than 6, 7, 8, or 9 amino acids.

Variants of the nucleotide and amino acid sequences are encompassed in the present invention. By "variant" is intended a sufficiently identical sequence. Accordingly, the invention encompasses isolated nucleic acid molecules that are sufficiently identical to the nucleotide sequences encoding protease-like proteins in SEQ ID NOS:2, 4, 6, 8, 9, 11, 13, 15, 17, 19, 21, 23, 25, 27, 29, 31, 33, 35, 37, 39, 41, 43, 45, 47, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, and 147, or nucleic acid molecules that hybridize to a nucleic acid molecule of SEQ ID NOS:1, 3, 5, 7, 10, 12, 14, 16, 18, 20, 22, 24, 26, 28, 30, 32, 34, 36, 38, 40, 42, 44, 46, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131 or 133, and 146, or a complement thereof, under stringent conditions. Variants also include polypeptides encoded by the variant nucleotide sequences of the present invention. In addition, polypeptides of the current invention have an amino acid sequence that is sufficiently identical to an amino acid sequence put forth in SEQ ID NOS:2, 4, 6, 8, 9, 11, 13, 15, 17, 19, 21, 23, 25, 27, 29, 31, 33, 35, 37, 39, 41, 43, 45, 47, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, and 147. By "sufficiently identical" is intended that one amino acid or nucleotide sequence contains a sufficient or minimal number of equivalent or identical amino acid residues as compared to a second amino acid or nucleotide sequence, thus providing a common structural domain and/or indicating a common functional activity. Conservative variants include those sequences that differ due to the degeneracy of the genetic code.

In general, amino acids or nucleotide sequences that have at least about 45%, 55%, or 65% identity, preferably at least about 70% or 75% identity, more preferably at least about 80%, 85% or 90%, most preferably at least about 91%, 92%, 93%, 94%, 95%, 96%, 97%, 98%, or 99% sequence identity to any of the amino acid sequences of SEQ ID NOS:2, 4, 6, 8, 9, 11, 13, 15, 17, 19, 21, 23, 25, 27, 29, 31, 33, 35, 37, 39, 41, 43, 45, 47, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, and 147, or any of the nucleotide sequences of SEQ ID NOS:1, 3, 5, 7, 10, 12, 14, 16, 18, 20, 22, 24, 26, 28, 30, 32, 34, 36, 38, 40, 42, 44, 46, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131 or 133, and 146 respectively, are defined herein as sufficiently identical. Variant proteins encompassed by the present invention are biologically active, that is they retain the desired biological activity of the native protein, that is, protease activity as described herein. A biologically active variant of a protein of the invention may differ from that protein by as few as 1-15 amino acid residues, as few as 1-10, such as 6-10, as few as 5, as few as 4, 3, 2, or even 1 amino acid residue.

Naturally occurring variants may exist within a population (e.g., the L. acidophilus population). Such variants can be identified by using well-known molecular biology techniques, including amplification techniques such as the polymerase chain reaction (PCR), and hybridization as described below. Synthetically derived nucleotide sequences, for example, sequences generated by site-directed mutagenesis or PCR-mediated mutagenesis, that still encode a protease-like protein, are also included as variants. One or more nucleotide or amino acid substitutions, additions, or deletions can be introduced into a nucleotide or amino acid sequence disclosed herein, such that the substitutions, additions, or deletions are introduced into the encoded protein. The additions (insertions) or deletions (truncations) may be made at the N-terminal or C-terminal end of the native protein, or at one or more sites in the native protein. Similarly, a substitution of one or more nucleotides or amino acids may be made at one or more sites in the native protein.

For example, conservative amino acid substitutions may be made at one or more predicted, preferably nonessential amino acid residues. A "nonessential" amino acid residue is a residue that can be altered from the wild-type sequence of a protein without altering the biological activity, whereas an "essential" amino acid is required for biological activity. A "conservative amino acid substitution" is one in which the amino acid residue is replaced with an amino acid residue with a similar side chain. Families of amino acid residues having similar side chains are known in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine).

Amino acid substitutions can be made in nonconserved regions that retain function. In general, such substitutions would not be made for conserved amino acid residues, or for amino acid residues residing within a conserved motif, where such residues are essential for protein activity. However, one of skill in the art would understand that functional variants may have minor conserved or nonconserved alterations in the conserved residues.

Alternatively, mutations can be made randomly along all or part of the length of the protease-like coding sequence, such as by saturation mutagenesis. The mutants can be expressed recombinantly, and screened for those that retain biological activity by assaying for protease-like activity using standard assay techniques. Methods for mutagenesis and nucleotide sequence alterations are known in the art. See, for example, Kunkel (1985) *Proc. Natl. Acad. Sci. USA* 82:488-492; Kunkel et al. (1987) *Methods in Enzymol. Molecular Biology* (MacMillan Publishing Company, New York) and the references sited therein. Obviously the mutations made in the DNA encoding the variant must not disrupt the reading frame and preferably will not create complimentary regions that could produce secondary mRNA structure. See, EP Patent Application Publication No. 75,444. Guidance as to appropriate amino acid substitutions that do not effect biological activity of the protein of interest may be found in the model of Dayhoff et al. (1978) *Atlas of Protein Sequence and Structure* (Natl. Biomed. Res. Found., Washington, D.C.), herein incorporated by reference.

The deletions, insertions, and substitutions of the protein sequences encompassed herein are not expected to produce radical changes in the characteristics of the protein. However, when it is difficult to predict the exact effect of the substitution, deletion, or insertion in advance of doing so, one skilled in the art will appreciate that the effect will be evaluated by routine screening assays. That is, the activity of peptidases can be evaluated by measuring hydrolyzing activity (see, for example, Sasaki et al. (1995) *J. Dairy Res.* 62:601-610, and Machuga and Ives (1984) *Biochim. Biophys. Acta* 789:26-36, herein incorporated by reference). The activity of proteinases can be evaluated by measuring proteolytic activity (see, for example, Fernandez-Espla et al. (2000) *Appl. Environ. Micro.* 66:4772-4778; Tuler et al. (2002) *J. Dairy Sci.* 85:2438-2450).

Variant nucleotide and amino acid sequences of the present invention also encompass sequences derived from mutagenic and recombinogenic procedures such as DNA shuffling. With such a procedure, one or more different protease-like protein coding regions can be used to create a new protease-like protein possessing the desired properties. In this manner, libraries of recombinant polynucleotides are generated from a population of related sequence polynucleotides comprising sequence regions that have substantial sequence identity and can be homologously recombined in vitro or in vivo. For example, using this approach, sequence motifs encoding a domain of interest may be shuffled between the protease-like gene of the invention and other known protease-like genes to obtain a new gene coding for a protein with an improved property of interest, such as an increased $K_m$ in the case of an enzyme. Strategies for such DNA shuffling are known in the art. See, for example, Stemmer (1994) *Proc. Natl. Acad. Sci. USA* 91:10747-10751; Stemmer (1994) *Nature* 370:389-391; Crameri et al. (1997) *Nature Biotech.* 15:436-438; Moore et al. (1997) *J. Mol. Biol.* 272:336-347; Zhang et al. (1997) *Proc. Natl. Acad. Sci. USA* 94:4504-4509; Crameri et al. (1998) *Nature* 391:288-291; and U.S. Pat. Nos. 5,605,793 and 5,837,458.

Variants of the protease-like proteins can function as either protease-like agonists (mimetics) or as protease-like antagonists. An agonist of the protease-like protein can retain substantially the same, or a subset, of the biological activities of the naturally occurring form of the protease-like protein. An antagonist of the protease-like protein can inhibit one or more of the activities of the naturally occurring form of the protease-like protein by, for example, competitively binding to a downstream or upstream member of a cellular signaling cascade that includes the protease-like protein.

Variants of a protease-like protein that function as either agonists or antagonists can be identified by screening combinatorial libraries of mutants, e.g., truncation mutants, of a protease-like protein for protease-like protein agonist or antagonist activity. In one embodiment, a variegated library of protease-like variants is generated by combinatorial mutagenesis at the nucleic acid level and is encoded by a variegated gene library. A variegated library of protease-like variants can be produced by, for example, enzymatically ligating a mixture of synthetic oligonucleotides into gene sequences such that a degenerate set of potential protease-like sequences is expressible as individual polypeptides, or alternatively, as a set of larger fusion proteins (e.g., for phage display) containing the set of protease-like sequences therein. There are a variety of methods that can be used to produce libraries of potential protease-like variants from a degenerate oligonucleotide sequence. Chemical synthesis of a degenerate gene sequence can be performed in an automatic DNA synthesizer, and the synthetic gene then ligated into an appropriate expression vector. Use of a degenerate set of genes allows for the provision, in one mixture, of all of the sequences encoding the desired set of potential protease-like sequences. Methods for synthesizing degenerate oligonucleotides are known in the art (see, e.g., Narang (1983) *Tetrahedron* 39:3; Itakura et al. (1984) *Annu. Rev. Biochem.* 53:323; Itakura et al. (1984) *Science* 198:1056; Ike et al. (1983) *Nucleic Acids Res.* 11:477).

In addition, libraries of fragments of a protease-like protein coding sequence can be used to generate a variegated population of protease-like fragments for screening and subsequent selection of variants of a protease-like protein. In one embodiment, a library of coding sequence fragments can be generated by treating a double-stranded PCR fragment of a protease-like coding sequence with a nuclease under conditions wherein nicking occurs only about once per molecule, denaturing the double-stranded DNA, renaturing the DNA to form double-stranded DNA which can include sense/antisense pairs from different nicked products, removing single-stranded portions from reformed duplexes by treatment with S1 nuclease, and ligating the resulting fragment library into an expression vector. By this method, one can derive an expression library that encodes N-terminal and internal fragments of various sizes of the protease-like protein.

Several techniques are known in the art for screening gene products of combinatorial libraries made by point mutations or truncation and for screening cDNA libraries for gene products having a selected property. Such techniques are adaptable for rapid screening of the gene libraries generated by the combinatorial mutagenesis of protease-like proteins. The most widely used techniques, which are amenable to high through-put analysis, for screening large gene libraries typically include cloning the gene library into replicable expression vectors, transforming appropriate cells with the resulting library of vectors, and expressing the combinatorial genes under conditions in which detection of a desired activity facilitates isolation of the vector encoding the gene whose product was detected. Recursive ensemble mutagenesis (REM), a technique that enhances the frequency of functional mutants in the libraries, can be used in combination with the screening assays to identify protease-like variants (Arkin and Yourvan (1992) *Proc. Natl. Acad. Sci. USA* 89:7811-7815; Delgrave et al. (1993) *Protein Engineering* 6(3):327-331).

Sequence Identity

The protease-like sequences are members of multiple families of molecules, with conserved functional features. By "family" is intended two or more proteins or nucleic acid molecules having sufficient nucleotide or amino acid sequence identity. A family that contains deeply divergent groups may be divided into subfamilies. A clan is a group of families that are thought to have common ancestry. Members of a clan often have a similar tertiary structure. Peptidases in the same family will have at least one domain with sequence identity, usually that domain responsible for catalytic activity. Families of peptidases differ in their catalytic mechanism, and may be serine-type, threonine-type, cysteine-type, aspartic-type, metallo-type or unknown type.

By "sequence identity" is intended the nucleotide or amino acid residues that are the same when aligning two sequences for maximum correspondence over at least one specified comparison window. By "comparison window" is intended a contiguous segment of the two nucleotide or amino acid sequences for optimal alignment, wherein the second sequence may contain additions or deletions (i.e., gaps) as compared to the first sequence. Generally, for nucleic acid alignments, the comparison window is at least 20 contiguous nucleotides in length, and optionally can be 30, 40, 50, 100, or longer. For amino acid sequence alignments, the comparison window is at least 6 contiguous amino acids in length, and optionally can be 10, 15, 20, 30, or longer. Those of skill in the art understand that to avoid a high similarity due to inclusion of gaps, a gap penalty is typically introduced and is subtracted from the number of matches.

Family members may be from the same or different species, and can include homologues as well as distinct proteins. Often, members of a family display common functional characteristics. Homologues can be isolated based on their identity to the *L. acidophilus* protease-like nucleic acid sequences disclosed herein using the cDNA, or a portion thereof, as a hybridization probe according to standard hybridization techniques under stringent hybridization conditions as disclosed below.

To determine the percent identity of two amino acid or nucleotide sequences, an alignment is performed. Percent identity of the two sequences is a function of the number of identical residues shared by the two sequences in the comparison window (i.e., percent identity=number of identical residues/total number of residues×100). In one embodiment, the sequences are the same length. Methods similar to those mentioned below can be used to determine the percent identity between two sequences. The methods can be used with or without allowing gaps. Alignment may also be performed manually by inspection.

When amino acid sequences differ in conservative substitutions, the percent identity may be adjusted upward to correct for the conservative nature of the substitution. Means for making this adjustment are known in the art. Typically the conservative substitution is scored as a partial, rather than a full mismatch, thereby increasing the percentage sequence identity.

Mathematical algorithms can be used to determine the percent identity of two sequences. Non-limiting examples of mathematical algorithms are the algorithm of Karlin and Altschul (1990) *Proc. Natl. Acad. Sci. USA* 87:2264, modified as in Karlin and Altschul (1993) *Proc. Natl. Acad. Sci. USA* 90:5873-5877; the algorithm of Myers and Miller (1988) *CABIOS* 4:11-17; the local alignment algorithm of Smith et al. (1981) *Adv. Appl. Math.* 2:482; the global alignment algorithm of Needleman and Wunsch (1970) *J. Mol. Biol.* 48:443-453; and the search-for-local-alignment method of Pearson and Lipman (1988) *Proc. Natl. Acad. Sci. USA* 85:2444-2448.

Various computer implementations based on these mathematical algorithms have been designed to enable the determination of sequence identity. The BLAST programs of Altschul et al. (1990) *J. Mol. Biol.* 215:403 are based on the algorithm of Karlin and Altschul (1990) supra. Searches to obtain nucleotide sequences that are homologous to nucleotide sequences of the present invention can be performed with the BLASTN program, score=100, wordlength=12. To obtain amino acid sequences homologous to sequences encoding a protein or polypeptide of the current invention, the BLASTX program may be used, score=50, wordlength=3. Gapped alignments may be obtained by using Gapped BLAST (in BLAST 2.0) as described in Altschul et al. (1997) *Nucleic Acids Res.* 25:3389. To detect distant relationships between molecules, PSI-BLAST can be used. See, Altschul et al. (1997) supra. For all of the BLAST programs, the default parameters of the respective programs can be used.

Another program that can be used to determine percent sequence identity is the ALIGN program (version 2.0), which uses the mathematical algorithm of Myers and Miller (1988) supra. A PAM120 weight residue table, a gap length penalty of 12, and a gap penalty of 4 can be used with this program when comparing amino acid sequences.

In addition to the ALIGN and BLAST programs, the BESTFIT, GAP, FASTA and TFASTA programs are part of the GCG Wisconsin Genetics Software Package, Version 10 (available from Accelrys Inc., 9685 Scranton Rd., San Diego, Calif., USA), and can be used for performing sequence alignments. The preferred program is GAP version 10, which used the algorithm of Needleman and Wunsch (1970) supra. Unless otherwise stated the sequence identity similarity values provided herein refer to the value obtained using GAP Version 10 with the following parameters: % identity and % similarity for a nucleotide sequence using GAP Weight of 50 and Length Weight of 3, and the nwsgapdna.cmp scoring matrix; % identity and % similarity for an amino acid sequence using GAP Weight of 8 and Length Weight of 2, and the BLOSUM62 Scoring Matrix; or any equivalent program. By "equivalent program" is intended any sequence comparison program that, for any two sequences in question, generates an alignment having identical nucleotide or amino acid residue matches and an identical percent sequence identity when compared to the corresponding alignment generated by GAP Version 10.

Alignment of a sequence in a database to a queried sequence produced by BLASTN, FASTA, BLASTP or like algorithm is commonly described as a "hit." Hits to one or more database sequences by a queried sequence produced by BLASTN, FASTA, BLASTP or a similar algorithm, align and identify similar portions of a sequence. A hit to a database sequence generally represents an overlap over a fraction of the sequence length of the queried sequence, i.e., a portion or fragment of the queried sequence. However, the overlap can represent the entire length of the queried sequence. The hits in an alignment to a queried sequence produced by BLASTN, FASTA, or BLASTP algorithms to sequences in a database are commonly arranged in order of the degree of similarity and the length of sequence overlap.

Polynucleotide and polypeptide hits aligned by BLASTN, FASTA, or BLASTP algorithms to a queried sequence produce "Expect" values. The Expect value (E value) indicates the number of hits one can "expect" to see over a certain number of contiguous sequences at random when searching a database of a certain size. The Expect value is used as a significance threshold for determining whether the hit to a database, such as the GENBANKT™ sequence or the EMBL database, indicates actual similarity. For example, an E value of 0.1 assigned to a polynucleotide hit is interpreted as meaning that in a database of the size of the GENBANK™ sequence database, one might expect to see 0.1 matches over the aligned portion of the sequence with a similar score randomly. By this criterion, the aligned and matched portions of the polynucleotide sequences then have a probability of 90% of being the same. For sequences having an E value of 0.01 or less over aligned and matched portions, the probability of finding a match randomly in the GENBANK™ sequence database is 1% or less, using the BLASTN or FASTA algorithm.

According to an embodiment of this invention, "variant" polynucleotides and polypeptides of this invention, comprise sequences producing an E value of about 0.01 or less when compared to the polynucleotide or polypeptide sequences of the present invention. That is, a variant polynucleotide or polypeptide is any sequence that has at least a 99% probability of being the same as the polynucleotide or polypeptide of the present invention, measured as having an E value of 0.01 or less using the BLASTN, FASTA, or BLASTP algorithms set at parameters described herein. In other embodiments, a variant polynucleotide is a sequence having the same number of, or fewer nucleic acids than a polynucleotide of the present invention that has at least a 99% probability of being the same as the polynucleotide of the present invention, measured as having an E value of 0.01 or less using the BLASTN or FASTA algorithms set at parameters described herein. Similarly, a variant polypeptide is a sequence having the same number of, or fewer amino acids than a polypeptide of the present invention that has at least a 99% probability of being the same as a polypeptide of the present invention, measured as having an E value of 0.01 or less using the BLASTP algorithm set at the parameters described herein.

As noted above, the percentage identity is determined by aligning sequences using one of the BLASTN, FASTA, or BLASTP algorithms, set at the running parameters described herein, and identifying the number of identical nucleic acids or amino acids over the aligned portions; dividing the number of identical nucleic acids or amino acids by the total number of nucleic acids or amino acids of the polynucleotide or polypeptide sequence of the present invention; and then multiplying by 100 to determine the percent identity. For example, a polynucleotide of the present invention having 220 nucleic acids has a hit to a polynucleotide sequence in the GENBANK™ sequence database having 520 nucleic acids over a stretch of 23 nucleotides in the alignment produced by the BLASTN algorithm using the parameters described herein. The 23 nucleotide hit includes 21 identical nucleotides, one gap and one different nucleotide. The percent identity of the polynucleotide of the present invention to the hit in the GENBANK™ sequence library is thus 21/220 times 100, or 9.5%. The polynucleotide sequence in the GENBANK™ sequence database is thus not a variant of a polynucleotide of the present invention.

Identification and Isolation of Homologous Sequences

Protease-like nucleotide sequences identified based on their sequence identity to the protease-like nucleotide sequences set forth herein, or to fragments and variants thereof, are encompassed by the present invention. Methods such as PCR or hybridization can be used to identify sequences from a cDNA or genomic library, for example that are substantially identical to sequence of the invention. See, for example, Sambrook et al. (1989) *Molecular Cloning: Laboratory Manual* (2d ed., Cold Spring Harbor Laboratory Press, Plainview, N.Y.) and Innis, et al. (1990) *PCR Protocols: A Guide to Methods and Applications* (Academic Press, New York). Methods for construction of such cDNA and genomic libraries are generally known in the art and are also disclosed in the above reference.

In hybridization techniques, the hybridization probes may be genomic DNA fragments, cDNA fragments, RNA fragments, or other oligonucleotides, and may consist of all or part of a known nucleotide sequence disclosed herein. In addition, they may be labeled with a detectable group such as $^{32}P$, or any other detectable marker, such as other radioisotopes, a fluorescent compound, an enzyme, or an enzyme co-factor. Probes for hybridization can be made by labeling synthetic oligonucleotides based on the nucleotide sequences disclosed herein. Degenerate primers designed on the basis of conserved nucleotides or amino acid residues in a known protease-like nucleotide sequence or encoded amino acid sequence can additionally be used. The hybridization probe typically comprises a region of nucleotide sequence that hybridizes under stringent conditions to at least about 10, preferably about 20, more preferably about 50, 75, 100, 125, 150, 175, 200, 250, 300, 350, or 400 consecutive nucleotides of a protease-like nucleotide sequence of the invention or a fragment or variant thereof. To achieve specific hybridization under a variety of conditions, such probes include sequences that are unique among protease-like protein sequences. Preparation of probes for hybridization is generally known in the art and is disclosed in Sambrook et al. (1989) *Molecular Cloning: A Laboratory Manual* (2d ed., Cold Spring Harbor Laboratory Press, Plainview, N.Y.), herein incorporated by reference.

In one embodiment, the entire nucleotide sequence encoding a protease-like protein is used as a probe to identify novel protease-like sequences and messenger RNAs. In another embodiment, the probe is a fragment of a nucleotide sequence disclosed herein. In some embodiments, the nucleotide sequence that hybridizes under stringent conditions to the probe can be at least about 300, 325, 350, 375, 400, 425, 450, 500, 550, 600, 650, 700, 800, 900, 1000, 1500, 2000, 2500, 3000, 3500, 4000, or 4500 nucleotides in length.

Substantially identical sequences will hybridize to each other under stringent conditions. By "stringent conditions" is intended conditions under which a probe will hybridize to its target sequence to a detectably greater degree than to other sequences (e.g., at least 2-fold over background). Generally, stringent conditions encompass those conditions for hybridization and washing under which nucleotides having at least about 60%, 65%, 70%, preferably 75% sequence identity typically remain hybridized to each other. Stringent conditions are known in the art and can be found in *Current Protocols in Molecular Biology* (John Wiley & Sons, New York (1989)), 6.3.1-6.3.6. Hybridization typically occurs for less than about 24 hours, usually about 4 to about 12 hours.

Stringent conditions are sequence dependent and will differ in different circumstances. Full-length or partial nucleic acid sequences may be used to obtain homologues and orthologs encompassed by the present invention. By "orthologs" is intended genes derived from a common ancestral gene and which are found in different species as a result of speciation. Genes found in different species are considered orthologs when their nucleotide sequences and/or their encoded protein sequences share substantial identity as defined elsewhere herein. Functions of orthologs are often highly conserved among species.

When using probes, stringent conditions will be those in which the salt concentration is less than about 1.5 M Na ion, typically about 0.01 to 1.0 M Na ion concentration (or other salts) at pH 7.0 to 8.3 and the temperature is at least about 30° C. for short probes (e.g., 10 to 50 nucleotides) and at least about 60° C. for long probes (e.g., greater than 50 nucleotides).

The post-hybridization washes are instrumental in controlling specificity. The two critical factors are ionic strength and temperature of the final wash solution. For the detection of sequences that hybridize to a full-length or approximately full-length target sequence, the temperature under stringent conditions is selected to be about 5° C. lower than the thermal melting point ($T_m$) for the specific sequence at a defined ionic strength and pH. However, stringent conditions would encompass temperatures in the range of 1° C. to 20° C. lower than the $T_m$, depending on the desired degree of stringency as otherwise qualified herein. For DNA-DNA hybrids, the $T_m$ can be determined using the equation of Meinkoth and Wahl (1984) *Anal. Biochem.* 138:267-284: $T_m$=81.5° C.+16.6 (logM)+0.41 (% GC)−0.61 (% form)−500/L; where M is the molarity of monovalent cations, % GC is the percentage of guanosine and cytosine nucleotides in the DNA, % form is the percentage of formamide in the hybridization solution, and L is the length of the hybrid in base pairs. The $T_m$ is the temperature (under defined ionic strength and pH) at which 50% of a complementary target sequence hybridizes to a perfectly matched probe.

The ability to detect sequences with varying degrees of homology can be obtained by varying the stringency of the hybridization and/or washing conditions. To target sequences that are 100% identical (homologous probing), stringency conditions must be obtained that do not allow mismatching. By allowing mismatching of nucleotide residues to occur, sequences with a lower degree of similarity can be detected (heterologous probing). For every 1% of mismatching, the $T_m$ is reduced about 1° C.; therefore, hybridization and/or wash conditions can be manipulated to allow hybridization of sequences of a target percentage identity. For example, if sequences with ≧90% sequence identity are preferred, the $T_m$ can be decreased by 10° C. Two nucleotide sequences could be substantially identical, but fail to hybridize to each other under stringent conditions, if the polypeptides they encode are substantially identical. This situation could arise, for example, if the maximum codon degeneracy of the genetic code is used to create a copy of a nucleic acid.

Exemplary low stringency conditions include hybridization with a buffer solution of 30-35% formamide, 1 M NaCl, 1% SDS (sodium dodecyl sulfate) at 37° C., and a wash in 1× to 2×SSC (20×SSC=3.0 M NaCl/0.3 M trisodium citrate) at 50 to 55° C. Exemplary moderate stringency conditions include hybridization in 40 to 45% formamide, 1.0 M NaCl, 1% SDS at 37° C., and a wash in 0.5× to 1×SSC at 55 to 60° C. Exemplary high stringency conditions include hybridization in 50% formamide, 1 M NaCl, 1% SDS at 37° C., and a wash in 0.1×SSC at 60 to 65° C. Optionally, wash buffers may comprise about 0.1% to about 1% SDS. Duration of hybridization is generally less than about 24 hours, usually about 4 to about 12 hours. An extensive guide to the hybridization of nucleic acids is found in Tijssen (1993) *Laboratory Techniques in Biochemistry and Molecular Biology—Hybridization with Nucleic Acid Probes*, Part I, Chapter 2 (Elsevier, New York); and Ausubel et al., Eds. (1995) *Current Protocols in Molecular Biology*, Chapter 2 (Greene Publishing and Wiley-Interscience, New York). See, Sambrook et al. (1989) *Molecular Cloning: A Laboratory Manual* (2d ed.; Cold Spring Harbor Laboratory Press, Plainview, N.Y.).

In a PCR approach, oligonucleotide primers can be designed for use in PCR reactions to amplify corresponding DNA sequences from cDNA or genomic DNA extracted from any organism of interest. PCR primers are preferably at least about 10 nucleotides in length, and most preferably at least about 20 nucleotides in length. Methods for designing PCR primers and PCR cloning are generally known in the art and are disclosed in Sambrook et al. (1989) *Molecular Cloning: A Laboratory Manual* (2d ed., Cold Spring Harbor Laboratory Press, Plainview, N.Y.). See also Innis et al., Eds. (1990) *PCR Protocols: A Guide to Methods and Applications* (Academic Press, New York); Innis and Gelfand, Eds. (1995) *PCR Strategies* (Academic Press, New York); and Innis and Gelfand, Eds. (1999) *PCR Methods Manual* (Academic Press, New York). Known methods of PCR include, but are not limited to, methods using paired primers, nested primers, single specific primers, degenerate primers, gene-specific primers, vector-specific primers, partially-mismatched primers, and the like.

Assays

Diagnostic assays to detect expression of the disclosed polypeptides and/or nucleic acid molecules as well as their disclosed activity in a sample are disclosed. An exemplary method for detecting the presence or absence of a disclosed nucleic acid or protein comprising the disclosed polypeptide in a sample involves obtaining a sample from a food/dairy/feed product, starter culture (mother, seed, bulk/set, concentrated, dried, lyophilized, frozen), cultured food/dairy/feed product, dietary supplement, bioprocessing fermentate, or a subject that has ingested a probiotic material, and contacting the sample with a compound or an agent capable of detecting the disclosed polypeptides or nucleic acids (e.g., an mRNA or genomic DNA comprising the disclosed nucleic acid or fragment thereof) such that the presence of the disclosed sequence is detected in the sample. Results obtained with a sample from the food, supplement, culture, product, or subject may be compared to results obtained with a sample from a control culture, product, or subject.

One agent for detecting the mRNA or genomic DNA comprising a disclosed nucleotide sequence is a labeled nucleic acid probe capable of hybridizing to the disclosed nucleotide sequence of the mRNA or genomic DNA. The nucleic acid probe can be, for example, a disclosed nucleic acid molecule, such as the nucleic acid of SEQ ID NOS:1, 3, 5, 7, 10, 12, 14, 16, 18, 20, 22, 24, 26, 28, 30, 32, 34, 36, 38, 40, 42, 44, 46, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131 or 133, and 146, or a portion thereof, such as a nucleic acid molecule of at least 10, 15, 20, 25, 30, 40, 50, 60, 70, 80, 90, 100, 200, 250, 300, 400 or 500 nucleotides in length and sufficient to specifically hybridize under stringent conditions to the mRNA or genomic DNA comprising the disclosed nucleic acid sequence. Other suitable probes for use in the diagnostic assays of the invention are described herein.

One agent for detecting a protein comprising a disclosed polypeptide sequence is an antibody capable of binding to the disclosed polypeptide, preferably an antibody with a detectable label. Antibodies can be polyclonal, or more preferably, monoclonal. An intact antibody, or a fragment thereof (e.g., Fab or F(ab')$_2$) can be used. The term "labeled," with regard to the probe or antibody, is intended to encompass direct labeling of the probe or antibody by coupling (i.e., physically linking) a detectable substance to the probe or antibody, as well as indirect labeling of the probe or antibody by reactivity with another reagent that is directly labeled. Examples of indirect labeling include detection of a primary antibody using a fluorescently labeled secondary antibody and end-labeling of a DNA probe with biotin such that it can be detected with fluorescently labeled streptavidin.

The term "sample" is intended to include tissues, cells, and biological fluids present in or isolated from a subject, as well as cells from starter cultures or food products carrying such cultures, or derived from the use of such cultures. That is, the detection method of the invention can be used to detect mRNA, protein, or genomic DNA comprising a disclosed sequence in a sample both in vitro and in vivo. In vitro techniques for detection of mRNA comprising a disclosed sequence include Northern hybridizations and in situ hybridizations. In vitro techniques for detection of a protein comprising a disclosed polypeptide include enzyme linked immunosorbent assays (ELISAs), Western blots, immunoprecipitations, and immunofluorescence. In vitro techniques for detection of genomic DNA comprising the disclosed nucleotide sequences include Southern hybridizations. Furthermore, in vivo techniques for detection of a protein comprising a disclosed polypeptide include introducing into a subject a labeled antibody against the disclosed polypeptide. For example, the antibody can be labeled with a radioactive marker whose presence and location in a subject can be detected by standard imaging techniques.

In one embodiment, the sample contains protein molecules from a test subject that has consumed a probiotic material. Alternatively, the sample can contain mRNA or genomic DNA from a starter culture.

The invention also encompasses kits for detecting the presence of disclosed nucleic acids or proteins comprising disclosed polypeptides in a sample. Such kits can be used to determine if a microbe expressing a specific polypeptide of the invention is present in a food product or starter culture, or in a subject that has consumed a probiotic material. For example, the kit can comprise a labeled compound or agent capable of detecting a disclosed polypeptide or mRNA in a sample and means for determining the amount of a the disclosed polypeptide in the sample (e.g., an antibody that recognizes the disclosed polypeptide or an oligonucleotide probe that binds to DNA encoding a disclosed polypeptide, e.g., SEQ ID NOS:2, 4, 6, 8, 9, 11, 13, 15, 17, 19, 21, 23, 25, 27, 29, 31, 33, 35, 37, 39, 41, 43, 45, 47, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, and 147). Kits can also include instructions detailing the use of such compounds.

For antibody-based kits, the kit can comprise, for example: (1) a first antibody (e.g., attached to a solid support) that binds to a disclosed polypeptide; and, optionally, (2) a second, different antibody that binds to the disclosed polypeptide or the first antibody and is conjugated to a detectable agent. For oligonucleotide-based kits, the kit can comprise, for example: (1) an oligonucleotide, e.g., a detectably labeled oligonucleotide, that hybridizes to a disclosed nucleic acid sequence or (2) a pair of primers useful for amplifying a disclosed nucleic acid molecule.

The kit can also comprise, e.g., a buffering agent, a preservative, or a protein stabilizing agent. The kit can also comprise components necessary for detecting the detectable agent (e.g., an enzyme or a substrate). The kit can also contain a control sample or a series of control samples that can be assayed and compared to the test sample contained. Each component of the kit is usually enclosed within an individual container, and all of the various containers are within a single package along with instructions for use.

In one embodiment, the kit comprises multiple probes in an array format, such as those described, for example, in U.S. Pat. Nos. 5,412,087 and 5,545,531, and International Publication No. WO 95/00530, herein incorporated by reference. Probes for use in the array may be synthesized either directly onto the surface of the array, as disclosed in International Publication No. WO 95/00530, or prior to immobilization onto the array surface (Gait, ed. (1984) *Oligonucleotide Synthesis a Practical Approach* IRL Press, Oxford, England). The probes may be immobilized onto the surface using techniques well known to one of skill in the art, such as those described in U.S. Pat. No. 5,412,087. Probes may be a nucleic acid or peptide sequence, preferably purified, or an antibody.

The arrays may be used to screen organisms, samples, or products for differences in their genomic, cDNA, polypeptide, or antibody content, including the presence or absence of specific sequences or proteins, as well as the concentration of those materials. Binding to a capture probe is detected, for example, by signal generated from a label attached to the nucleic acid molecule comprising the disclosed nucleic acid sequence, a polypeptide comprising the disclosed amino acid sequence, or an antibody. The method can include contacting the molecule comprising the disclosed nucleic acid, polypeptide, or antibody with a first array having a plurality of capture probes and a second array having a different plurality of capture probes. The results of each hybridization can be compared to analyze differences in expression between a first and second sample. The first plurality of capture probes can be from a control sample, e.g., a wild type lactic acid bacteria, or control subject, e.g., a food, dietary supplement, starter culture sample, or a biological fluid. The second plurality of capture probes can be from an experimental sample, e.g., a mutant type lactic acid bacteria, or subject that has consumed a probiotic material, e.g., a starter culture sample or a biological fluid.

These assays may be especially useful in microbial selection and quality control procedures where the detection of unwanted materials is essential. The detection of particular nucleotide sequences or polypeptides may also be useful in determining the genetic composition of food, fermentation products, or industrial microbes, or microbes present in the digestive system of animals or humans that have consumed probiotics.

Antisense Nucleotide Sequences

The present invention also encompasses antisense nucleic acid molecules, i.e., molecules that are complementary to a sense nucleic acid encoding a protein, e.g., complementary to the coding strand of a double-stranded cDNA molecule, or complementary to an mRNA sequence. Accordingly, an antisense nucleic acid can hydrogen bond to a sense nucleic acid. The antisense nucleic acid can be complementary to an entire protease-like coding strand, or to only a portion thereof, e.g., all or part of the protein coding region (or open reading frame). An antisense nucleic acid molecule can be antisense to a noncoding region of the coding strand of a nucleotide sequence encoding a protease-like protein. The noncoding regions are the 5' and 3' sequences that flank the coding region and are not translated into amino acids. Antisense nucleotide sequences are useful in disrupting the expression of the target gene. Antisense constructs having 70%, preferably 80%, more preferably 85% sequence identity to the corresponding sequence may be used.

Given the coding-strand sequence encoding a protease-like protein disclosed herein (e.g., SEQ ID NOS:2, 4, 6, 8, 9, 11, 13, 15, 17, 19, 21, 23, 25, 27, 29, 31, 33, 35, 37, 39, 41, 43, 45, 47, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, and 147), antisense nucleic acids of the invention can be designed according to the rules of Watson and Crick base pairing. The antisense nucleic acid molecule can be complementary to the entire coding region of a protease-like mRNA, but more preferably is an oligonucleotide that is antisense to only a portion of the coding or noncoding region of a protease-like mRNA. For example, the antisense oligonucleotide can be complementary to the region surrounding the translation start site of a protease-like mRNA. An antisense oligonucleotide can be, for example, about 5, 10, 15, 20, 25, 30, 35, 40, 45, or 50 nucleotides in length, or it can be 100 or 200 nucleotides, or greater in length. An antisense nucleic acid of the invention can be constructed using chemical synthesis and enzymatic ligation procedures known in the art.

For example, an antisense nucleic acid (e.g., an antisense oligonucleotide) can be chemically synthesized using naturally occurring nucleotides or variously modified nucleotides designed to increase the biological stability of the molecules or to increase the physical stability of the duplex formed between the antisense and sense nucleic acids, including, but not limited to, for example e.g., phosphorothioate derivatives and acridine substituted nucleotides. Alternatively, the antisense nucleic acid can be produced biologically using an expression vector into which a nucleic acid has been subcloned in an antisense orientation (i.e., RNA transcribed from the inserted nucleic acid will be of an antisense orientation to a target nucleic acid of interest).

An antisense nucleic acid molecule of the invention can be an α-anomeric nucleic acid molecule. An α-anomeric nucleic acid molecule forms specific double-stranded hybrids with complementary RNA in which, contrary to the usual β-units, the strands run parallel to each other (Gaultier et al. (1987) *Nucleic Acids Res.* 15:6625-6641). The antisense nucleic acid molecule can also comprise a 2'-o-methylribonucleotide (Inoue et al. (1987) *Nucleic Acids Res.* 15:6131-6148) or a chimeric RNA-DNA analogue (Inoue et al. (1987) *FEBS Lett.* 215:327-330).

The invention also encompasses ribozymes, which are catalytic RNA molecules with ribonuclease activity that are capable of cleaving a single-stranded nucleic acid, such as an mRNA, to which they have a complementary region. Ribozymes (e.g., hammerhead ribozymes (described in Haselhoff and Gerlach (1988) *Nature* 334:585-591)) can be used to catalytically cleave protease-like mRNA transcripts to thereby inhibit translation of protease-like mRNA. A ribozyme having specificity for a protease-like-encoding nucleic acid can be designed based upon the nucleotide sequence of a protease-like cDNA disclosed herein (e.g., SEQ ID NOS:1, 3, 5, 7, 10, 12, 14, 16, 18, 20, 22, 24, 26, 28, 30, 32, 34, 36, 38, 40, 42, 44, 46, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131 or 133, and 146). See, e.g., Cech et al., U.S. Pat. No. 4,987,071; and Cech et al., U.S. Pat. No. 5,116, 742. Alternatively, protease-like mRNA can be used to select a catalytic RNA having a specific ribonuclease activity from a pool of RNA molecules. See, e.g., Bartel and Szostak (1993) *Science* 261:1411-1418.

The invention also encompasses nucleic acid molecules that form triple helical structures. For example, protease-like gene expression can be inhibited by targeting nucleotide sequences complementary to the regulatory region of the protease-like protein (e.g., the protease-like promoter and/or enhancers) to form triple helical structures that prevent transcription of the protease-like gene in target cells. See generally, Helene (1991) *Anticancer Drug Des.* 6(6):569; Helene (1992) *Ann. N.Y. Acad. Sci.* 660:27; and Maher (1992) *Bioassays* 14(12):807.

In some embodiments, the nucleic acid molecules of the invention can be modified at the base moiety, sugar moiety, or phosphate backbone to improve, e.g., the stability, hybridization, or solubility of the molecule. For example, the deoxyribose phosphate backbone of the nucleic acids can be modified to generate peptide nucleic acids (see, Hyrup et al. (1996) *Bioorganic & Medicinal Chemistry* 4:5). As used herein, the terms "peptide nucleic acids" or "PNAs" refer to nucleic acid mimics, e.g., DNA mimics, in which the deoxyribose phosphate backbone is replaced by a pseudopeptide backbone and only the four natural nucleobases are retained. The neutral backbone of PNAs has been shown to allow for specific hybridization to DNA and RNA under conditions of low ionic strength. The synthesis of PNA oligomers can be performed using standard solid-phase peptide synthesis protocols as described, for example, in Hyrup et al. (1996) supra; Perry-O'Keefe et al. (1996) *Proc. Natl. Acad. Sci. USA* 93:14670.

PNAs can be used as antisense or antigene agents for sequence-specific modulation of gene expression by, e.g., inducing transcription or translation arrest or inhibiting replication. PNAs of the invention can also be used, e.g., in the analysis of single base pair mutations in a gene by, e.g., PNA-directed PCR clamping; as artificial restriction enzymes when used in combination with other enzymes, e.g., S1 nucleases (Hyrup (1996) supra); or as probes or primers for DNA sequence and hybridization (Hyrup (1996) supra; Perry-O'Keefe et al. (1996) supra).

In another embodiment, PNAs of a protease-like molecule can be modified, e.g., to enhance their stability, specificity, or cellular uptake, by attaching lipophilic or other helper groups to PNA, by the formation of PNA-DNA chimeras, or by the use of liposomes or other techniques of drug delivery known in the art. The synthesis of PNA-DNA chimeras can be performed as described in Hyrup (1996), supra; Finn et al. (1996)

*Nucleic Acids Res.* 24(17):3357-63; Mag et al. (1989) *Nucleic Acids Res.* 17:5973; and Peterson et al. (1975) *Bioorganic Med. Chem. Lett.* 5:1119.

Fusion Proteins

The invention also includes protease-like chimeric or fusion proteins. A protease-like "chimeric protein" or "fusion protein" comprises a protease-like polypeptide operably linked to a non-protease-like polypeptide. A "protease-like polypeptide" refers to a polypeptide having an amino acid sequence corresponding to a protease-like protein, whereas a "non-protease-like polypeptide" refers to a polypeptide having an amino acid sequence corresponding to a protein that is not substantially identical to the protease-like protein, and which is derived from the same or a different organism. Within a protease-like fusion protein, the protease-like polypeptide can correspond to all or a portion of a protease-like protein, preferably including at least one biologically active portion of a protease-like protein. Within the fusion protein, the term "operably linked" is intended to indicate that the protease-like polypeptide and the non-protease-like polypeptide are fused in-frame to each other. The non-protease-like polypeptide can be fused to the N-terminus or C-terminus of the protease-like polypeptide.

Expression of the linked coding sequences results in two linked heterologous amino acid sequences that form the fusion protein. The carrier sequence (the non-protease-like polypeptide) can encode a carrier polypeptide that potentiates or increases expression of the fusion protein in the bacterial host. The portion of the fusion protein encoded by the carrier sequence, i.e., the carrier polypeptide, may be a protein fragment, an entire functional moiety, or an entire protein sequence. The carrier region or polypeptide may additionally be designed to be used in purifying the fusion protein, either with antibodies or with affinity purification specific for that carrier polypeptide. Likewise, physical properties of the carrier polypeptide can be exploited to allow selective purification of the fusion protein.

Particular carrier polypeptides of interest include superoxide dismutase (SOD), maltose-binding protein (MBP), glutathione-S-transferase (GST), an N-terminal histidine (His) tag, and the like. This list is not intended to be limiting, as any carrier polypeptide that potentiates expression of the protease-like protein as a fusion protein can be used in the methods of the invention.

In one embodiment, the fusion protein is a GST-protease-like fusion protein in which the protease-like sequences are fused to the C-terminus of the GST sequences. In another embodiment, the fusion protein is a protease-like-immunoglobulin fusion protein in which all or part of a protease-like protein is fused to sequences derived from a member of the immunoglobulin protein family. The protease-like-immunoglobulin fusion proteins of the invention can be used as immunogens to produce anti-protease-like antibodies in a subject, to purify protease-like ligands, and in screening assays to identify molecules that inhibit the interaction of a protease-like protein with a protease-like ligand.

In one embodiment of the invention, the fusion protein has the ability to modify the functional properties of a bacterial cell. By "functional properties" is intended a bacterium's ability to perform certain non-native functions, such as those related to adhesion, immune stimulation, or lysis. The non-protease-like protein may include, but is not limited to, an antibody, an enzyme, a vaccine antigen, a protein with bactericidal activity, or a protein with receptor-binding activity. By "bactericidal activity" is intended the ability to kill one or more bacteria. By "receptor-binding activity" is intended the ability to bind to a receptor on a cell membrane, cell surface, or in solution. Methods for constructing and testing fusion vectors that contain the LPXTG motif (SEQ ID NO: 135) and a heterologous protein are well known in the art (see, for example, Leenhouts et al. (1999) *Antonie van Leeuwenhoek* 76:367-376; Steidler et al. (1998) *Appl. Environ. Microbiol.* 64:342-345). Methods to assess the ability of a fusion protein expressed on the surface of Gram-positive bacteria to be used as a vaccine are known in the art (see, for example, Fischetti et al. (1996) *Curr. Opin. Biotechnol.* 7:659-666; Pouwels et al. (1998) *Int. J. Food Microbiol.* 41:155-167).

One of skill in the art will recognize that the particular carrier polypeptide is chosen with the purification scheme in mind. For example, His tags, GST, and maltose-binding protein represent carrier polypeptides that have readily available affinity columns to which they can be bound and eluted. Thus, where the carrier polypeptide is an N-terminal His tag such as hexahistidine ($His_6$ tag), the protease-like fusion protein can be purified using a matrix comprising a metal-chelating resin, for example, nickel nitrilotriacetic acid (Ni-NTA), nickel iminodiacetic acid (Ni-IDA), and cobalt-containing resin (Co-resin). See, for example, Steinert et al. (1997) *QIAGEN News* 4:11-15, herein incorporated by reference in its entirety. Where the carrier polypeptide is GST, the protease-like fusion protein can be purified using a matrix comprising glutathione-agarose beads (Sigma or Pharmacia Biotech); where the carrier polypeptide is a maltose-binding protein (MBP), the protease-like fusion protein can be purified using a matrix comprising an agarose resin derivatized with amylose.

Preferably, a chimeric or fusion protein of the invention is produced by standard recombinant DNA techniques. For example, DNA fragments coding for the different polypeptide sequences may be ligated together in-frame, or the fusion gene can be synthesized, such as with automated DNA synthesizers. Alternatively, PCR amplification of gene fragments can be carried out using anchor primers that give rise to complementary overhangs between two consecutive gene fragments, which can subsequently be annealed and re-amplified to generate a chimeric gene sequence (see, e.g., Ausubel et al., eds. (1995) *Current Protocols in Molecular Biology* (Greene Publishing and Wiley-Interscience, New York). Moreover, a protease-like-encoding nucleic acid can be cloned into a commercially available expression vector such that it is linked in-frame to an existing fusion moiety.

The fusion protein expression vector is typically designed for ease of removing the carrier polypeptide to allow the protease-like protein to retain the native biological activity associated with it. Methods for cleavage of fusion proteins are known in the art. See, for example, Ausubel et al., Eds. (1998) *Current Protocols in Molecular Biology* (John Wiley & Sons, Inc.). Chemical cleavage of the fusion protein can be accomplished with reagents such as cyanogen bromide, 2-(2-nitrophenylsulphenyl)-3-methyl-3'-bromoindolenine, hydroxylamine, or low pH. Chemical cleavage is often accomplished under denaturing conditions to cleave otherwise insoluble fusion proteins.

Where separation of the protease-like polypeptide from the carrier polypeptide is desired and a cleavage site at the junction between these fused polypeptides is not naturally occurring, the fusion construct can be designed to contain a specific protease cleavage site to facilitate enzymatic cleavage and removal of the carrier polypeptide. In this manner, a linker sequence comprising a coding sequence for a peptide that has a cleavage site specific for an enzyme of interest can be fused in-frame between the coding sequence for the carrier polypeptide (for example, MBP, GST, SOD, or an N-terminal His tag) and the coding sequence for the protease-like polypeptide. Suitable enzymes having specificity for cleavage sites include, but are not limited to, factor Xa, thrombin, enterokinase, remin, collagenase, and tobacco etch virus (TEV) protease. Cleavage sites for these enzymes are well known in the art. Thus, for example, where factor Xa is to be used to cleave the carrier polypeptide from the protease-like polypeptide, the fusion construct can be designed to comprise a linker sequence encoding a factor Xa-sensitive cleavage site, for example, the sequence IEGR (see, for example, Nagai and Thøgersen (1984) *Nature* 309:810-812, Nagai and Thøgersen (1987) *Meth. Enzymol.* 153:461-481, and Pryor and Leiting (1997) *Protein Expr. Purif.* 10(3):309-319, herein incorporated by reference). Where thrombin is to be used to cleave the carrier polypeptide from the protease-like polypeptide, the fusion construct can be designed to comprise a linker sequence encoding a thrombin-sensitive cleavage site, for example the sequence LVPRGS or VIAGR (see, for example, Pryor and Leiting (1997) *Protein Expr. Purif.* 10(3):309-319, and Hong et al. (1997) *Chin. Med. Sci. J.* 12(3):143-147, respectively, herein incorporated by reference). Cleavage sites for TEV protease are known in the art. See, for example, the cleavage sites described in U.S. Pat. No. 5,532,142, herein incorporated by reference in its entirety. See also the discussion in Ausubel et al., Eds. (1998) *Current Protocols in Molecular Biology* (John Wiley & Sons, Inc.), Chapter 16.

Antibodies

An isolated polypeptide of the present invention can be used as an immunogen to generate antibodies that specifically bind protease-like proteins, or stimulate production of antibodies in vivo. The full-length protease-like protein can be used as an immunogen or, alternatively, antigenic peptide fragments of protease-like proteins as described herein can be used. The antigenic peptide of a protease-like protein comprises at least 8, preferably 10, 15, 20, or 30 amino acid residues of an amino acid sequence as found in SEQ ID NOS:2, 4, 6, 8, 9, 11, 13, 15, 17, 19, 21, 23, 25, 27, 29, 31, 33, 35, 37, 39, 41, 43, 45, 47, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, and 147, and encompasses an epitope of an protease-like protein such that an antibody raised against the peptide forms a specific immune complex with the protease-like protein. Preferred epitopes encompassed by the antigenic peptide are regions of a protease-like protein that are located on the surface of the protein, e.g., hydrophilic regions.

Recombinant Expression Vectors

The nucleic acid molecules of the present invention may be included in vectors, preferably expression vectors. "Vector" refers to a nucleic acid molecule capable of transporting another nucleic acid to which it has been linked. Expression vectors include one or more regulatory sequences and direct the expression of genes to which they are operably linked. By "operably linked" is intended that the nucleotide sequence of interest is linked to the regulatory sequence(s) such that expression of the nucleotide sequence is allowed (e.g., in an in vitro transcription/translation system or in a host cell when the vector is introduced into the host cell). The term "regulatory sequence" is intended to include controllable transcriptional promoters, operators, enhancers, transcriptional terminators, and other expression control elements such as translational control sequences (e.g., Shine-Dalgarno consensus sequence, initiation and termination codons). These regulatory sequences will differ, for example, depending on the host cell being used.

The vectors can be autonomously replicated in a host cell (episomal vectors), or may be integrated into the genome of a host cell, and replicated along with the host genome (non-episomal mammalian vectors). Integrating vectors typically contain at least one sequence homologous to the bacterial chromosome that allows for recombination to occur between homologous DNA in the vector and the bacterial chromosome. Integrating vectors may also comprise bacteriophage or transposon sequences. Episomal vectors, or plasmids are circular double-stranded DNA loops into which additional DNA segments can be ligated. Plasmids capable of stable maintenance in a host are generally the preferred form of expression vectors when using recombinant DNA techniques.

The expression constructs or vectors encompassed in the present invention comprise a nucleic acid construct of the invention in a form suitable for expression of the nucleic acid in a host cell. Expression in prokaryotic host cells is encompassed in the present invention. It will be appreciated by those skilled in the art that the design of the expression vector can depend on such factors as the choice of the host cell to be transformed, the level of expression of protein desired, etc. The expression vectors of the invention can be introduced into host cells to thereby produce proteins or peptides, including fusion proteins or peptides, encoded by nucleic acids as described herein (e.g., protease-like proteins, mutant forms of protease-like proteins, fusion proteins, etc.).

Regulatory sequences include those that direct constitutive expression of a nucleotide sequence as well as those that direct inducible expression of the nucleotide sequence only under certain environmental conditions. A bacterial promoter is any DNA sequence capable of binding bacterial RNA polymerase and initiating the downstream (3') transcription of a coding sequence (e.g., structural gene) into mRNA. A promoter will have a transcription initiation region, which is usually placed proximal to the 5' end of the coding sequence. This transcription initiation region typically includes an RNA polymerase binding site and a transcription initiation site. A bacterial promoter may also have a second domain called an operator, which may overlap an adjacent RNA polymerase binding site at which RNA synthesis begins. The operator permits negative regulated (inducible) transcription, as a gene repressor protein may bind the operator and thereby inhibit transcription of a specific gene. Constitutive expression may occur in the absence of negative regulatory elements, such as the operator. In addition, positive regulation may be achieved by a gene activator protein binding sequence, which, if present is usually proximal (5') to the RNA polymerase binding sequence.

An example of a gene activator protein is the catabolite activator protein (CAP), which helps initiate transcription of the lac operon in *Escherichia coli* (Raibaud et al. (1984) *Annu. Rev. Genet.* 18:173). Regulated expression may therefore be either positive or negative, thereby either enhancing or reducing transcription. Other examples of positive and negative regulatory elements are well known in the art. Various promoters that can be included in the protein expression system include, but are not limited to, a T7/LacO hybrid promoter, a trp promoter, a T7 promoter, a lac promoter, and a bacteriophage lambda promoter. Any suitable promoter can be used to carry out the present invention, including the native promoter or a heterologous promoter. Heterologous promoters may be constitutively active or inducible. A non-limiting example of a heterologous promoter is given in U.S. Pat. No. 6,242,194 to Kullen and Klaenhammer.

Sequences encoding metabolic pathway enzymes provide particularly useful promoter sequences. Examples include promoter sequences derived from sugar metabolizing enzymes, such as galactose, lactose (lac) (Chang et al. (1987) *Nature* 198:1056), and maltose. Additional examples include promoter sequences derived from biosynthetic enzymes such as tryptophan (trp) (Goeddel et al. (1980) *Nucleic Acids Res.* 8:4057; Yelverton et al. (1981) *Nucleic Acids Res.* 9:731; U.S. Pat. No. 4,738,921; EPO Publication Nos. 36,776 and 121,775). The beta-lactamase (bla) promoter system (Weissmann, (1981) "The Cloning of Interferon and Other Mistakes," in *Interferon* 3 (ed. I. Gresser); bacteriophage lambda PL (Shimatake et al. (1981) *Nature* 292:128); the arabinose-inducible araB promoter (U.S. Pat. No. 5,028,530); and T5 (U.S. Pat. No. 4,689,406) promoter systems also provide useful promoter sequences. See also Balbas (2001) *Mol. Biotech.* 19:251-267, where *E. coli* expression systems are discussed.

In addition, synthetic promoters that do not occur in nature also function as bacterial promoters. For example, transcription activation sequences of one bacterial or bacteriophage promoter may be joined with the operon sequences of another bacterial or bacteriophage promoter, creating a synthetic hybrid promoter (U.S. Pat. No. 4,551,433). For example, the tac (Amann et al. (1983) *Gene* 25:167; de Boer et al. (1983) *Proc. Natl. Acad. Sci.* 80:21) and trc (Brosius et al. (1985) *J. Biol. Chem.* 260:3539-3541) promoters are hybrid trp-lac promoters comprised of both trp promoter and lac operon sequences that are regulated by the lac repressor. The tac promoter has the additional feature of being an inducible regulatory sequence. Thus, for example, expression of a coding sequence operably linked to the tac promoter can be induced in a cell culture by adding isopropyl-1-thio-β-D-galactoside (IPTG). Furthermore, a bacterial promoter can include naturally occurring promoters of non-bacterial origin that have the ability to bind bacterial RNA polymerase and initiate transcription. A naturally occurring promoter of non-bacterial origin can also be coupled with a compatible RNA polymerase to produce high levels of expression of some genes in prokaryotes. The bacteriophage T7 RNA polymerase/promoter system is an example of a coupled promoter system (Studier et al. (1986) *J. Mol. Biol.* 189:113; Tabor et al. (1985) *Proc. Natl. Acad. Sci.* 82:1074). In addition, a hybrid promoter can also be comprised of a bacteriophage promoter and an *E. coli* operator region (EPO Publication No. 267, 851).

The vector may additionally contain a gene encoding the repressor (or inducer) for that promoter. For example, an inducible vector of the present invention may regulate transcription from the Lac operator (LacO) by expressing the gene encoding the LacI repressor protein. Other examples include the use of the lexA gene to regulate expression of pRecA, and the use of trpO to regulate ptrp. Alleles of such genes that increase the extent of repression (e.g., lacIq) or that modify the manner of induction (e.g., λCI857, rendering λpL thermo-inducible, or λCI+, rendering λ.pL chemo-inducible) may be employed.

In addition to a functioning promoter sequence, an efficient ribosome-binding site is also useful for the expression of the fusion construct. In prokaryotes, the ribosome binding site is called the Shine-Dalgarno (SD) sequence and includes an initiation codon (ATG) and a sequence 3-9 nucleotides in length located 3-11 nucleotides upstream of the initiation codon (Shine et al. (1975) *Nature* 254:34). The SD sequence is thought to promote binding of mRNA to the ribosome by the pairing of bases between the SD sequence and the 3' end of bacterial 16S rRNA (Steitz et al. (1979) "Genetic Signals and Nucleotide Sequences in Messenger RNA," in *Biological Regulation and Development: Gene Expression* (ed. R. F. Goldberger, Plenum Press, NY).

Protease-like proteins can also be secreted from the cell by creating chimeric DNA molecules that encode a protein comprising a signal peptide sequence fragment that provides for secretion of the protease-like polypeptides in bacteria (U.S. Pat. No. 4,336,336). The signal sequence fragment typically encodes a signal peptide comprised of hydrophobic amino acids that direct the secretion of the protein from the cell. The protein is either secreted into the growth media (Gram-positive bacteria) or into the periplasmic space, located between the inner and outer membrane of the cell (Gram-negative bacteria). Preferably there are processing sites, which can be cleaved either in vivo or in vitro, encoded between the signal peptide fragment and the protease-like protein.

DNA encoding suitable signal sequences can be derived from genes for secreted bacterial proteins, such as the E. coli outer membrane protein gene (ompA) (Masui et al. (1983) *FEBS Lett.* 151(1):159-164; Ghrayeb et al. (1984) *EMBO J.* 3:2437-2442) and the *E. coli* alkaline phosphatase signal sequence (phoA) (Oka et al. (1985) *Proc. Natl. Acad. Sci.* 82:7212). Other prokaryotic signals include, for example, the signal sequence from penicillinase, Ipp, or heat stable enterotoxin II leaders.

Bacteria such as *L. acidophilus* generally utilize the start codon ATG, which specifies the amino acid methionine (which is modified to N-formylmethionine in prokaryotic organisms). Bacteria also recognize alternative start codons, such as the codons GTG and TTG, which code for valine and leucine, respectively. When they are used as the initiation codon, however, these codons direct the incorporation of methionine rather than of the amino acid they normally encode. *Lactobacillus acidophilus* NCFM recognizes these alternative start sites and incorporates methionine as the first amino acid.

Typically, transcription termination sequences recognized by bacteria are regulatory regions located 3' to the translation stop codon and thus, together with the promoter, flank the coding sequence. These sequences direct the transcription of an mRNA that can be translated into the polypeptide encoded by the DNA. Transcription termination sequences frequently include DNA sequences (of about 50 nucleotides) that are capable of forming stem loop structures that aid in terminating transcription. Examples include transcription termination sequences derived from genes with strong promoters, such as the trp gene in *E. coli* as well as other biosynthetic genes.

The expression vectors will have a plurality of restriction sites for insertion of the protease-like sequence so that it is under transcriptional regulation of the regulatory regions. Selectable marker genes that ensure maintenance of the vector in the cell can also be included in the expression vector. Preferred selectable markers include those that confer resistance to drugs such as ampicillin, chloramphenicol, erythromycin, kanamycin (neomycin), and tetracycline (Davies et al. (1978) *Annu. Rev. Microbiol.* 32:469). Selectable markers may also allow a cell to grow on minimal medium, or in the presence of toxic metabolite and may include biosynthetic genes, such as those in the histidine, tryptophan, and leucine biosynthetic pathways.

The regulatory regions may be native (homologous), or may be foreign (heterologous) to the host cell and/or the nucleotide sequence of the invention. The regulatory regions may also be natural or synthetic. Where the region is "foreign" or "heterologous" to the host cell, it is intended that the region is not found in the native cell into which the region is introduced. Where the region is "foreign" or "heterologous" to the protease-like nucleotide sequence of the invention, it is intended that the region is not the native or naturally occurring region for the operably linked protease-like nucleotide sequence of the invention. For example, the region may be derived from phage. While it may be preferable to express the sequences using heterologous regulatory regions, native regions may be used. Such constructs would be expected in some cases to alter expression levels of protease-like proteins in the host cell. Thus, the phenotype of the host cell could be altered.

In preparing the expression cassette, the various DNA fragments may be manipulated, so as to provide for the DNA sequences in the proper orientation and, as appropriate, in the proper reading frame. Toward this end, adapters or linkers may be employed to join the DNA fragments or other manipulations may be involved to provide for convenient restriction sites, removal of superfluous DNA, removal of restriction sites, or the like. For this purpose, in vitro mutagenesis, primer repair, restriction, annealing, resubstitutions, e.g., transitions and transversions, may be involved.

The invention further provides a recombinant expression vector comprising a DNA molecule of the invention cloned into the expression vector in an antisense orientation. That is, the DNA molecule is operably linked to a regulatory sequence in a manner that allows for expression (by transcription of the DNA molecule) of an RNA molecule that is antisense to protease-like mRNA. Regulatory sequences operably linked to a nucleic acid cloned in the antisense orientation can be chosen to direct the continuous or inducible expression of the antisense RNA molecule. The antisense expression vector can be in the form of a recombinant plasmid or phagemid in which antisense nucleic acids are produced under the control of a high efficiency regulatory region, the activity of which can be determined by the cell type into which the vector is introduced. For a discussion of the regulation of gene expression using antisense genes; see, Weintraub et al. (1986) *Reviews—Trends in Genetics, Vol.* 1(1).

Alternatively, some of the above-described components can be put together in transformation vectors. Transformation vectors are typically comprised of a selectable market that is either maintained in a replicon or developed into an integrating vector, as described above.

Microbial or Bacterial Host Cells

The production of bacteria containing the nucleic acid sequences or proteins designated, the preparation of starter cultures of such bacteria, and methods of fermenting substrates, particularly food substrates such as milk, may be carried out in accordance with known techniques. (See, for example, Gilliland, S. E. (ed) Bacterial Starter Cultures for Food, CRC press, 1985, 205 pp.; Read, G. (Ed.). Prescott and Dunn's Industrial Microbiology, $4^{th}$ Ed. AVI Publishing Company, Inc. 1982, 883 pp.; Peppler, J. J. and Perlman, D. (Eds.). Microbial Technology: Volume II, Fermentation Technology. Academic Press, 1979, 536 pp.)

By "fermenting" is intended the energy-yielding, metabolic breakdown of organic compounds by microorganisms that generally proceeds under anaerobic conditions and with the evolution of gas.

By "introducing" as it pertains to nucleic acid molecules is intended introduction into prokaryotic cells via conventional transformation or transfection techniques, or by phage-mediated infection. As used herein, the terms "transformation," "transduction," conjugation, and protoplast fusion are intended to refer to a variety of art-recognized techniques for introducing foreign nucleic acid (e.g., DNA) into a host cell, including calcium phosphate or calcium chloride co-precipitation, DEAE-dextran-mediated transfection, lipofection, or electroporation. Suitable methods for transforming or transfecting host cells can be found in Sambrook et al. (1989) *Molecular Cloning: A Laboratory Manual* (2d ed., Cold Spring Harbor Laboratory Press, Plainview, N.Y.) and other laboratory manuals. By "introducing" as it pertains to polypeptides or microorganisms of the invention, is intended introduction into a host by ingestion, topical application, nasal, urogenital, suppository, or oral application of the polypeptide or microorganism.

Bacterial cells used to produce the protease-like polypeptides of this invention are cultured in suitable media, as described generally in Sambrook et al. (1989) *Molecular Cloning, A Laboratory Manual* (2d ed., Cold Spring Harbor Laboratory Press, Plainview, N.Y.).

Methods of Use

Methods are provided wherein properties of microbes used in fermentation are modified to provide strains able to produce more, or improved, products for human or animal health, strains producing enhanced flavors, textures, or odors of fermented products, and strains which permit more efficient or more economic fermentation procedures. The polypeptides of the invention may be introduced into a microorganism that does not naturally express the polypeptide, or the polypeptide may be expressed in a microorganism that already expresses the polypeptide. In this way, the polypeptide of the invention is a heterologous polypeptide. By "heterologous" is intended a sequence that originates from a foreign species, or, if from the same species, is substantially modified from its native form in composition and/or genomic locus by deliberate human intervention.

In one embodiment, a polypeptide of the invention may modulate the growth rate of a bacterium. By "growth rate" is intended a measure of the rate of growth of an organism or culture. When a microorganism is grown in continuous liquid culture at an exponential growth rate, the increase in cell mass can be expressed in terms of the specific growth rate constant ($\mu$): $dP/dt=\mu \times P$, where P is the cell mass and t is the time. The polypeptide of the invention may be expressed or overexpressed in a bacterium. By "overexpressing" is intended that the protein of interest is produced in an increased amount in the modified bacterium compared to its production in a wild-type bacterium. Assays to measure the growth rate of bacteria are known in the art (see, for example, Bruinenberg et al. (1992) *Appl. Environ. Microbiol.* 58:78-84).

In another embodiment, the polypeptide of the invention may modulate the acidification rate of a milk product fermented by lactic acid bacteria. By "acidification rate" is intended the rate at which the pH is lowered during fermentation. Assays to measure the acidification rate in fermentation are known in the art (see, for example, Bruinenberg et al. (1992) *Appl. Environ. Microbiol.* 58:78-84).

The polypeptides of the invention, when introduced into a fermentative organism, may also affect the cleavage specificity or cleavage rate of a culture used for fermentation, thereby affecting the rate of proteolysis.

In still other embodiments, fragments of a polynucleotide or polypeptide of the invention, in combination with protease fragments from species other than *L. acidophilus*, can be constructed to form a hybrid protease with modified cleavage specificity or cleavage rate (Siezen (1999) *Antonie Van Leeuwenhoek* 76:139-155). By "cleavage specificity" is intended the degree of selectivity shown by an enzyme with respect to the number and types of substrates the enzyme cleaves. By "substrate cleavage rate" is intended the rate at which the enzyme cleaves its substrate. By "constructing" is intended that the sequence is assembled using molecular biological techniques, and is not isolated from a wild-type cell. By "hybrid protease" is intended that the protease is constructed using one or more fragments of a protease gene from more than one species. Assays to measure the cleavage specificity and rate of an enzyme are well known in the art (see, for example, Vos et al. (1991) *Protein Eng.* 4:479-484; Siezen et al. (1993) *Protein Eng.* 6:927-937).

In alternative embodiments, a mutein of a polypeptide of the invention may have a modified cleavage specificity or rate compared to a wild-type *L. acidophilus* protease. By "mutein" is intended a mutant protein. Methods used to mutate wild-type proteases include site-directed mutagenesis and domain knock-out. By "domain knock-out" is intended a method wherein one or more domains of the protein are removed. Site-directed mutagenesis and domain knock-out are well known techniques (see, for example, Sambrook et al. (1989) *Molecular Cloning: A Laboratory Manual* (2d ed., Cold Spring Harbor Laboratory Press, Plainview, N.Y.; Siezen (1999) *Antonie Van Leewenhoek* 76:139-155).

In another embodiment, a polynucleotide or polypeptide of the invention may modulate the rate of cheese ripening. Cheese ripening is a very complex biochemical process. Each variety of cheese requires unique ripening conditions depending on the amount of proteolysis required to create its characteristic flavor. The flavors and textures unique to each cheese type are a result of glycolysis, lipolysis, and especially proteolysis (Fox et al. (1996) *Antonie Van Leeuwenhoek* 70:271-297). Since proteolysis is the rate-limiting step, the acceleration of proteolysis would be of great economic importance. Alternatively, a decreased proteolytic rate may allow for more flexible processing of fermented products. Variants of a polypeptide sequence of the current invention may have an altered cleavage rate. Methods to assay proteolytic rates are known in the art (see, for example, Vos et al. (1991) *Protein Eng.* 4:479-484).

In another embodiment, a polynucleotide or polypeptide of the invention may increase flavor diversification of fermented milk products. By "flavor diversification" is intended the variety of flavors present in a fermented product. Methods for the organoleptic evaluation of cheese are well known in the art (see, for example, Meijer et al. (1998) *Appl. Environ. Micro.* 64:1950-1953).

In yet another embodiment, a polynucleotide or polypeptide of the invention may enhance the stability of a microorganism, including *L. acidophilus*. By "stability" is intended the ability of a microorganism to withstand stress. By "enhancing" is intended an increase in the ability. Assays to measure bacterial stability are well known in the art (see, for example, (Gilliland, S. E. (ed.) Bacterial Starter Cultures for Foods, CRC Press, 1985. 205 pp.).

Proteases and Peptidases

Peptidases are grouped into clans and families. Clans are groups of families for which there is evidence of common ancestry. Families are grouped by their catalytic type, with the first character representing the catalytic type: S, serine; T, threonine; C, cysteine; A, aspartic; M, metallo and U, unknown. A clan that contains families of more than one type is described as being of type P. The serine, threonine and cysteine peptidases utilize the catalytic part of an amino acid as a nucleophile and form an acyl intermediate—these peptidases can also readily act as transferases. In the case of aspartic and metallopeptidases, the nucleophile is an activated water molecule.

Serine Peptidases

Proteolytic enzymes that exploit serine in their catalytic activity are ubiquitous, being found in viruses, bacteria and eukaryotes. They include a wide range of peptidase activity, including exopeptidase, endopeptidase, oligopeptidase and omega-peptidase activity. Over 20 families (denoted S1-S27) of serine protease have been identified, these being grouped into 6 clans (SA, SB, SC, SE, SF and SG) on the basis of structural similarity and other functional evidence (Rawlings and Barrett (1994) *Methods Enzymol.* 244:461-86). Structures are known for four of the clans (SA, SB, SC and SE): these appear to be totally unrelated, suggesting at least four evolutionary origins of serine peptidases and possibly many more. Notwithstanding their different evolutionary origins, there are similarities in the reaction mechanisms of several peptidases. Chymotrypsin, subtilisin and carboxypeptidase C clans have a catalytic triad of serine, aspartate and histidine in common: serine acts as a nucleophile, aspartate as an electrophile, and histidine as a base (Rawlings and Barrett, 1994, supra). The geometric orientations of the catalytic residues are similar between families, despite different protein folds (Rawlings and Barrett, 1994, supra). The linear arrangements of the catalytic residues commonly reflect clan relationships. For example the catalytic triad in the chymotrypsin clan (SA) is ordered HDS, but is ordered DHS in the subtilisin clan (SB) and SDH in the carboxypeptidase clan (SC) (Rawlings and Barrett (1993) *Biochem. J.* 290:205-18).

SEQ ID NO:58 is a member of the D-alanyl-D-alanine carboxypeptidase family (PFAM Accession No. PF00768). This group of serine peptidases belongs to MEROPS peptidase family S11 (D-Ala-D-Ala carboxypeptidase A family, clan SE). There are three families of serine-type D-Ala-D-Ala peptidase, which are also known as low molecular weight penicillin-binding proteins. Family S11 contains only D-Ala-D-Ala peptidases. The protein fold of the peptidase domain for members of this family resembles that of D-Ala-D-Ala-carboxypeptidase B, the type example for clan SE. D-Ala-D-Ala carboxypeptidase A is involved in the metabolism of cell components (Ghuysen (1991) *Annu. Rev. Microbiol.* 45:37-67); it is synthesized with a leader peptide to target it to the cell membrane (Rawlings and Barrett, 1994, supra). After cleavage of the leader peptide, the enzyme is retained in the membrane by a C-terminal anchor. Methods for measuring serine carboxypeptidase activity are well known in the art (see, for example, Ramirez-Zavala et al. (2004) *Int. J. Food Microbiol.* 91:245-52).

SEQ ID NOS:41 and 70 are members of the Peptidase S24-like family (PFAM Accession No. PF00717). This signature is associated with serine peptidases that belong to MEROPS peptidase families S24 (LexA family, clan SF), S26A (signal peptidase I) and S26B (signalase). The S24 family, of which SEQ ID NO:41 is a member, includes: the lambda repressor CI/C2 family and related bacterial prophage repressor proteins; LexA, the repressor of genes in the cellular SOS response to DNA damage; MucA and the related UmuD proteins, which are lesion-bypass DNA polymerases, induced in response to mitogenic DNA damage; and RulA, a component of the rulAB locus that confers resistance to UV. All of these proteins, with the possible exception of RulA, interact with RecA, which activates self cleavage either derepressing transcription in the case of CI and LexA or activating the lesion-bypass polymerase in the case of UmuD and MucA. The S26A and B families are signal peptidases (Spases), also known as leader peptidases, which remove signal peptides from secretory proteins. SEQ ID NO:70 is an S26 protein. In prokaryotes three types of SPases are known: type I (gene lepB) which is responsible for the processing of the majority of exported pre-proteins; type II (gene lsp) which only process lipoproteins, and a third type involved in the processing of pili subunits. Methods to measure serine-type peptidase activity are well known in the art (see, for example, van Dijl et al. (1995) *J. Biol. Chem.* 270:3611-8).

SEQ ID NO:41 is also a member of the LexA DNA binding domain family (PFAM Accession No. PF01726). This is the DNA binding domain of the LexA SOS regulon repressor that prevents expression of DNA repair proteins in bacteria. This domain is found associated with Peptidase_S24 (PFAM Accession No. PF00717), the auto-proteolytic domain of LexA (EC: 3.4.21.88). Methods to measure repressor LexA activity are well known in the art (see, for example, Little et al. (1981) *Proc. Natl. Acad. Sci. U.S.A.* 78:4199-203).

SEQ ID NO:52 is a member of the Subtilase family (PFAM Accession No. PF00082). This group of serine peptidases belongs to the MEROPS peptidase families S8 (subfamilies S8A (subtilisin) and S8B (kexin)) and S53 (sedolisin), both of which are members of clan SB. The subtilisin family is the second largest serine protease family characterized to date. It is widespread, being found in eubacteria, archaebacteria, eukaryotes and viruses (Rawlings and Barrett, 1994, supra). The vast majority of the family members are endopeptidases, although there is an exopeptidase and a tripeptidyl peptidase. Structures have been determined for several members of the subtilisin family: they exploit the same catalytic triad as the chymotrypsins, although the residues occur in a different order (HDS in chymotrypsin and DHS in subtilisin). Based on sequence homology, a subdivision into six families has been proposed (Siezen and Leunissen (1997) *Protein Sci.* 6:501-23). Methods for measuring subtilase activity are well known in the art (see, for example, Kim and Choi (2000) *Biosci. Biotechnol. Biochem.* 64:1722-1725).

SEQ ID NO:50 is a member of the X-Pro dipeptidyl-peptidase (S15 family) (PFAM Accession No. PF02129). This family of sequences is made up of serine peptidases belonging to MEROPS peptidase family S15 (clan SC) (Rawlings and Barrett, 1994, supra). The type example is X-Pro dipeptidyl-peptidase of *Lactococcus lactis*. These proteins, which have similar specificity to mammalian dipeptidyl-peptidase IV, cleave Xaa-Pro-releasing N-terminal dipeptides. The penultimate residue must be proline. In *L. lactis* the proteins exist as cytoplasmic homodimers. In lactobacilli, X-Pro dipeptidyl-peptidase is involved in the casein-degradation pathway, providing essential amino acids to the lactobacilli (Yüksel and Steele (1996) *Appl. Microbiol. Biotechnol* 44:766-773). Methods for measuring X-Pro aminopeptidase activity are well known in the art (see, for example, Yüksel and Steele, 1996, supra).

Cysteine Peptidases

Cysteine peptidases have characteristic molecular topologies, which can be seen not only in their three-dimensional structures, but commonly also in the two-dimensional structures. The peptidase domain is responsible for peptide bond hydrolysis; in Merops this is termed the peptidase unit. These are peptidases in which the nucleophile is the sulfhydryl group of a cysteine residue. Cysteine proteases are divided into clans (proteins which are evolutionarily related), and further sub-divided into families, on the basis of the architecture of their catalytic dyad or triad (Barrett and Rawlings (2001) *Biol. Chem.* 382:727-33). Clan CA contains the families of papain (C1), calpain (C2), streptopain (C10) and the ubiquitin-specific peptidases (C12, C19), as well as many families of viral cysteine endopeptidases. Clan CD contains the families of clostripain (C11), gingipain R (C25), legumain (C13), caspase-1 (C14) and separin (C50). These enzymes have specificities dominated by the interactions of the S1 subsite. Clan CE contains the families of adenain (C5) from adenoviruses, the eukaryotic Ulp1 protease (C48) and the bacterial YopJ proteases (C55). Clan CF contains only pyroglutamyl peptidase I (C15). Clan PA contains the picornains (C3), which have probably evolved from serine peptidases and which form the majority of enzymes in this clan. Clans PB and CH contain the autolytic cysteine peptidases.

SEQ ID NOS:8, 9, 11, 19, 29, 114, and 118 are members of the Peptidase C1-like family (PFAM Accession No. PF03051). This group of proteins belongs to the peptidase family C1, sub-family C1B (bleomycin hydrolase, clan CA). This family is closely related to the Peptidase_C1 family (PFAM Accession No. PF00112), containing several prokaryotic and eukaryotic aminopeptidases and bleomycin hydrolases. Methods to measure cysteine-type peptidase activity are well known in the art (see, for example, Chapot-Chartier et al. (1994) *Eur. J. Biochem.* 224:497-506).

SEQ ID NOS:13, 15, 60, 66, 98, 120, and 126 are members of the Peptidase U34 family (PFAM Accession No. PF03577). This group of peptidases belongs to MEROPS peptidase family C69 (dipeptidase A family, clan PB), which appear to be mainly dipeptidases (Vesanto et al. (1996) *Appl. Microbiol. Biotechnol.* 45:638-45). Methods to measure dipeptidase activity are well known in the art (see, for example, Vesanto, 1996, supra).

SEQ ID NO:6 is a member of the Pyroglutamyl peptidase family (PFAM Accession No. PF01470). This group of cysteine peptidases belongs to MEROPS peptidase family C15 (pyroglutamyl peptidase I, clan CF). Peptidase family C15 contains omega peptidases that release an N-terminal pyroglutamate (pGlu) residue. Pyroglutamyl/pyrrolidone carboxyl peptidase (Pcp or PYRase) is an exopeptidase that hydrolytically removes the pGlu from pGlu-peptides or pGlu-proteins (Awade et al. (1994) *Proteins* 20:34-51; Awade et al. (1992) *FEBS Lett.* 305:67-73). PYRase has been found in prokaryotes and eukaryotes, where at least two different classes have been characterized: the first containing bacterial and animal type I PYRases, and the second containing animal type II and serum PYRases. Type I and bacterial PYRases are soluble enzymes, while type II PYRases are membrane-bound. The conserved residues Cys-144 and His-168 have been identified by inhibition and mutagenesis studies (Awade et al., 1994, supra; Gonzales and Robert-Baudouy (1994) *J. Bacteriol.* 176:2569-76). Methods to measure pyroglutamyl-peptidase I activity are well known in the art (see, for example, Awade et al., 1994, supra).

Metalloproteases

Metalloproteases are the most diverse of the four main types of protease, with more than 30 families identified to date. In these enzymes, a divalent cation, usually zinc, activates the water molecule. The metal ion is held in place by amino acid ligands, usually three in number. The known metal ligands are His, Glu, Asp or Lys and at least one other residue is required for catalysis, which may play an electrophilic role. Of the known metalloproteases, around half contain a His-Glu-Xaa-Xaa-His (SEQ ID NO:148, or "HEXXH") motif, which has been shown in crystallographic studies to form part of the metal-binding site (Rawlings and Barrett (1995) *Methods Enzymol.* 248:183-228). The HEXXH motif is relatively common, but can be more stringently defined for metalloproteases as abXHEbbHbc (SEQ ID NO: 136), where 'a' is most often valine or threonine and forms part of the S1' subsite in thermolysin and neprilysin, 'b' is an uncharged residue, and 'c' is a hydrophobic residue. Proline is never found in this site, possibly because it would break the helical structure adopted by this motif in metalloproteases (Rawlings and Barrett, 1995, supra).

SEQ ID NOS:21 and 23 are members of the glycoprotease family (PFAM Accession No. PF00814). This group of metallopeptidases belongs to MEROPS peptidase family M22

(clan MK). Peptidase family M22 contains an endopeptidase that cleaves only proteins that are O-sialoglycosylated. The Peptidase M22 proteins are part of the HSP70-actin superfamily. The region represented here is an insert into the fold and is not found in the rest of the family (beyond the Peptidase M22 family). This region also contains the histidine dyad believed to coordinate the metal ion and hence provide catalytic activity. The zinc-binding and catalytic residues of this family have not been determined, although the motif HMEGH (SEQ ID NO: 137) may be a zinc-binding region (Rawlings and Barrett, 1995, supra). The nature of the active site is unknown, but it has been suggested that an HXXEXXH (SEQ ID NO:149) motif, conserved in some members of the family, is akin to the HEXXH motif found in clan MA, in which the histidines are zinc ligands and the glutamate is a catalytic residue. Methods to measure O-sialoglycoprotein endopeptidase activity are well known in the art (see, for example, Mellors and Lo (1995) *Methods Enzymol.* 248:728-40).

SEQ ID NO:86 is a member of the Insulinase (Peptidase M16) family (PFAM Accession No. PF00675). Members in this family are metalloendopeptidases and non-peptidase homologs belonging to MEROPS peptidase family M16 (clan ME), subfamilies M16A, M16B and M16C. These proteins share some regions of sequence similarity in the N-terminal section. This region includes a conserved histidine followed two residues later by a glutamate and another histidine (His-Xaa-Xaa-Glu-His, SEQ ID NO:154, or "HXXEH" motif). In pitrilysin, it has been shown (Fujita et al. (1994) *Nature* 372:567-70) that this HXXEH motif is involved in enzymatic activity; the two histidines bind zinc and the glutamate is necessary for catalytic activity. Methods for measuring metalloendopeptidase activity are well known in the art (see, for example, Yan et al. (1987) *Eur. J. Biochem.* 163:259-65).

SEQ ID NO: 134 is a member of the Peptidase M16 inactive domain family (PFAM Accession No. PF05193). Peptidase M16 consists of two structurally related domains. One is the active peptidase, whereas the other is inactive. The two domains hold the substrate like a clamp (Taylor et al. (2001) *Structure (Camb)* 9:615-25). These metallopeptidases belong to MEROPS peptidase family M16 (clan ME).

SEQ ID NO: 102 is a member of the M42 glutamyl aminopeptidase family (PFAM Accession No. PF05343). This group of metallopeptidases belongs to MEROPS peptidase family M42 (glutamyl aminopeptidase family, clan MH). These peptidases are co-catalytic metallopeptidases, typically binding two atoms of zinc or cobalt. For members of this family and family M28, the predicted metal ligands occur in the same order in the sequence: HDE(D/E)H (SEQ ID NO: 138); and the active site residues occur in the motifs HXD and EE. Some of the enzymes exhibit typical aminopeptidase specificity, whereas others are also able to hydrolyze acylated N-terminal residues, the so-called "N-terminal deblocking activity." Characteristics commonly reported are exceptional thermal stability and a requirement for cobalt ions for maximal activity. Methods for measuring glutamyl aminopeptidase activity are well known in the art (see, for example, Ando et al. (1999) *FEBS Lett.* 447:25-8).

SEQ ID NOS:25, 27, and 45 are members of the metallopeptidase M24 family (PFAM Accession No. PF00557). This group of metallopeptidases and non-peptidase homologs belongs to MEROPS peptidase family M24 (clan MG). It includes the enzymes proline dipeptidase and methionine aminopeptidase. Peptidase family M24 contains exopeptidases that require co-catalytic ions of cobalt or manganese. The methionyl aminopeptidases of subfamily M24A are essential for the removal of the initiating methionine of many proteins, acting co-translationally in association with the ribosomes (Chang and Lee (1992) *J. Biol. Chem.* 267: 3952-3958). The X-Pro dipeptidase found in eukaryotes has a role in the cleavage of Xaa-Pro linkages found in dipeptides associated with collagen recycling. Methods for measuring metalloexopeptidase activity are well known in the art (see, for example, Chang and Lee, 1992, supra).

SEQ ID NOS:56 and 68 are members of the Peptidase M1 family (PFAM Accession No. PF01433). This group of metallopeptidases belongs to the MEROPS peptidase family M1 (clan MA(E)). The peptidases of family M1 are dependent on a single zinc ion for activity and all members of the family act on the N-terminus of polypeptides, many of them being aminopeptidases. The members differ widely in specificity, hydrolyzing acidic, basic or neutral N-terminal residues. In the active site, a catalytic zinc ion is bound by two histidines and a glutamate. The histidines are within an HEXXH motif on one long helix with the glutamate on another antiparallel helix. The catalytic mechanism is believed to involve activation of a water molecule by the zinc ion. The glutamate of the HEXXH motif is known to be important for catalysis and a tyrosine may also be involved. Membrane alanine aminopeptidase (EC:3.4.11.2) is part of the HEXXH$^+$E group (SEQ ID NO: 139); it consists entirely of aminopeptidases, spread across a wide variety of species (Rawlings and Barrett, 1995, supra). Methods to measure membrane alanyl aminopeptidase activity are well known in the art (see, for example, Ferracci and Maroux (1980) *Biochim. Biophys. Acta* 599: 448-63).

SEQ ID NOS:4, 39 and 116 are members of the Peptidase M13 family (PFAM Accession No. PF01431). This group of metallopeptidases belongs to the MEROPS peptidase family M13 (neprilysin family, clan MA(E)). Peptidase family M13 contains metalloendopeptidases restricted to action on substrates smaller than proteins. In the active site, there is an HEXXH motif, in which the His residues are ligands of a zinc atom and the Glu has a catalytic role. There is also a more C-terminal Glu residue that is the third ligand of the zinc atom. The protein fold of the peptidase unit for members of this family resembles that of thermolysin, the type example for clan MA. Methods for measuring metallopeptidase activity are well known in the art (see, for example, Yan et al. (1987) *Eur. J. Biochem.* 163:259-65).

SEQ ID NOS:31, 37, 54, and 104 are members of the Peptidase M20/M25/M40 family (PFAM Accession No. PF01546). This group of proteins contains the metallopeptidases and non-peptidase homologues that belong to the MEROPS peptidase family M20 (clan MH) (Rawlings and Barrett, 1995, supra). This family includes a range of zinc metallopeptidases belonging to several families in the peptidase classification. Peptidase family M20 contains exopeptidases: carboxypeptidases, dipeptidases and a specialized aminopeptidase. Peptidase family M25 contains X-His dipeptidases. The peptidases of this clan have two catalytic zinc ions at the active site, bound by His/Asp, Asp, Glu, Asp/Glu and His (SEQ ID NO:140). The catalyzed reaction involves the release of an N-terminal amino acid, usually neutral or hydrophobic, from a polypeptide. The peptidases are of the 'co-catalytic' type, binding two metal ions per monomer of protein. There are five metal-ligand residues, because one ligates both metal ions, and the general arrangement of these is: (H/D)DE(E/D)H (SEQ ID NO:140). With the addition of two catalytic residues (bold), the full set of active site residues becomes: (H/D)DDEE(E/D)H (SEQ ID NO:141), but there are variations in the individual subfamilies. Peptidase T (M20.003) acts only on tripeptide substrates and has therefore been termed a tripeptidase. Methods for measuring metallopeptidase activity are well known in the art (see, for example, Chang and Lee, 1992, supra).

SEQ ID NO:64 is a member of the Peptidase M3 family (PFAM Accession No. PF01432). This group of metallopeptidases belongs to MEROPS peptidase family M3 (clan MA(E)), subfamilies M3A and M3B. This is the Thimet oligopeptidase family, a large family of mammalian and bacterial oligopeptidases that cleave medium sized peptides. The peptidases of family M3 are high-molecular-mass (about 80 kDa) zinc metalloendopeptidases. They contain the HEXXH motif that forms the active site in conjunction with a C-terminally-located Glu residue. A single zinc ion is ligated by the side chains of the two His residues, and the more C-terminal Glu. Both thimet oligopeptidase (M03.001) and neurolysin (M03.002) are oligopeptidases, acting only on substrates of less than about 19 amino acid residues, with a particular preference for cleaving near the C-terminus (Knight et al. (1995) *Biochem. J.* 308:145-150). Methods for measuring metalloendopeptidase activity are well known in the art (see, for example, Yan et al. (1987) *Eur. J. Biochem.* 163:259-65).

SEQ ID NO:100 is a member of the Peptidase M48 family (PFAM Accession No. PF01435). This group of metallopeptidases belongs to MEROPS peptidase family M48 (Ste24 endopeptidase family, clan M-); members of both subfamily are represented. The members of this set of proteins are homologs of protease htpX (EC:3.4.24) or CAAX (Cys-Ala-Ala-Xaa, SEQ ID NO: 150) prenyl protease 1, which proteolytically removes the C-terminal three residues of famesylated proteins. They are integral membrane proteins associated with the endoplasmic reticulum and Golgi complex, binding one zinc ion per subunit. In *Saccharomyces cerevisiae* Ste24p is required for the first NH2-terminal proteolytic processing event within the a-factor precursor, which takes place after COOH-terminal CAAX (SEQ ID NO: 150) modification is complete. The Ste24p contains multiple predicted membrane spans, a zinc metalloprotease motif (HEXXH, SEQ ID NO:148), and a COOH-terminal ER retrieval signal (KKXX; SEQ ID NO:151). The HEXXH protease motif is critical for Ste24p activity, since Ste24p fails to function when conserved residues within this motif are mutated. The Ste24p homologues occur in a diverse group of organisms, including *Escherichia coli, Schizosaccharomyces pombe, Haemophilus influenzae,* and *Homo sapiens,* which indicates that the gene is highly conserved throughout evolution. Ste24p and the proteins related to it define a subfamily of proteins that are likely to function as intracellular, membrane-associated zinc metalloproteases (Fujimura-Kamada et al. (1997) *J. Cell Biol.* 136:271-285). Methods for measuring metalloendopeptidase activity are well known in the art (see, for example, Yan et al. (1987) *Eur. J. Biochem.* 163:259-65).

SEQ ID NOS:106, 108, and 110 are members of the Peptidase propeptide and YPEB domain family (PFAM Accession No. PF03413). This signature, PepSY, is found in the propeptide of members of the MEROPS peptidase family M4 (clan MA(E)), which contains the thermostable thermolysins (EC:3.4.24.27), and related thermolabile neutral proteases (bacillolysins) (EC:3.4.24.28) from various species of *Bacillus*. Many extracellular bacterial proteases are produced as proenzymes. The propeptides usually have a dual function, i.e., they function as an intramolecular chaperone required for the folding of the polypeptide and as an inhibitor, preventing premature activation of the enzyme. Analysis of the propeptide region of the M4 family of peptidases reveals two regions of conservation, the PepSY domain and a second domain, proximal to the N terminus, the FTP domain (PFAM Accession No. PFO7504), which is also found in isolation in the propeptide of eukaryotic peptidases belong to MEROPS peptidase family M36. All peptidases in the family bind a single, catalytic zinc ion. As in many other families of metallopeptidases, there is an HEXXH motif, in which the histidines are zinc ligands and the glutamate (Glu375) is an active site residue. This common motif was refined by Jongeneel et al. ((1989) *FEBS Lett.* 242:211-214). The Jongeneel consensus identifies most mono-catalytic zinc metallopeptidases from a number of families. The zinc is bound by a glutamate (Glu398), 20-33 residues C-terminal to the HEXXH motif. Metallopeptidases in which the zinc is bound by HEXXH plus Glu (SEQ ID NO:139) are known as "Glu-zincins." A zinc ion is tetrahedrally co-ordinated, and the fourth ligand is activated water that forms the nucleophile in catalysis. Residues found to be essential for catalysis are Tyr389, Asp402, Asp458 and His463. Asp402 is completely conserved amongst all active members of the family and forms a hydrogen bond with His463 (Argos et al. (1978) *J. Mol. Biol* 126: 141-158); the EXXXD (SEQ ID NO: 152) is a second useful motif for detecting members of the family. Most members of the family are endopeptidases active at neutral pH. Proteins and peptides are degraded with a preference for cleavage of Xaa+Yaa, in which Xaa is a hydrophobic residue and Yaa is Leu, Phe, Ile, or Val. Thermolysin has a two-domain structure with the active site between the domains. The N-terminal domain includes a distinctive six-strand beta sheet with two helices, one of which carries the HEXXH zinc-binding motif. The C-terminal domain, which is unique for the family, is predominantly helical and carries the third zinc ligand. Thermolysin is the type-example of clan MA. Other families in clan MA, such as M10 and M12, share a similar core structure to the thermolysin N-terminal domain, but the C-terminal domains are unrelated. Most members of the family are secreted enzymes that degrade extracellular proteins and peptides for bacterial nutrition, especially prior to sporulation. Methods to measure zinc ion binding are well known in the art (see, for example, Tang et al. (2003) *Biochem. Biophys. Res. Commun.* 301:1093-8).

Aspartic Endopeptidases

Aspartic endopeptidases (EC:3.4.23) of vertebrate, fungal and retroviral origin have been characterized (Szecsi et al. (1992) *Scand. J. Clin. Lab. Invest. Suppl.* 210:5-22). Aspartate peptidases are so named because Asp residues are the ligands of the activated water molecule in all examples where the catalytic residues have been identified, although at least one viral enzyme is believed to have an Asp and an Asn as its catalytic dyad. All or most aspartate peptidases are endopeptidases. These enzymes have been assigned into clans (proteins which are evolutionary related), and further sub-divided into families, largely on the basis of their tertiary structure.

SEQ ID NO:17 is a member of the Bacterial Peptidase A24 N-terminal domain family (PFAM Accession No. PF06750). This family is found at the N-terminus of the prepilin peptidases family (PFAM Accession No. PF01478). Some of the family members have been characterized as bifunctional (Strom et al. (1993) *J. Biol. Chem.* 268:15788-94), and this domain may contain the N-methylation activity (EC:2.1.1.-). The domain consists of an intracellular region between a pair of transmembrane domains. This intracellular region contains an invariant proline and two almost fully conserved disulfide bridges, hence the name DiS-P-DiS. These four conserved cysteines are arranged in a two-pair motif, with the Cys residues of a pair separated (usually) by two amino acids and with each pair separated by 21 largely hydrophilic residues; they have been shown to be essential to the overall function of the enzyme (Strom et al., 1993, supra). SEQ ID NO: 17 is a prepilin peptidase (EC 3.4.99.-), which processes the N-terminus of the prepilins (Albers et al. (2003) *J. Bacteriol.* 185:3918-25). The processing is essential for the correct formation of the pseudopili of type IV bacterial protein secretion. Prepilin leader peptidases are found on the cytosolic membrane surface, where they have dual activity, involving cleavage of glycine-phenylalanine bonds and methylation of the newly-revealed N-terminal phenylalanine. The consensus sequence for the site of proteolytic cleavage is GFT(L/I) (SEQ ID NO:142), in which the Gly P1 residue is essential (Rawlings and Barrett, 1994, supra). Methods to measure cysteine-type peptidase activity are well known in the art (see, for example, Strom et al., 1993, supra).

SEQ ID NO:33 is a member of the Signal peptidase (SPase) II family (PFAM Accession No. PF01252). This group of aspartic peptidases belongs to the MEROPS peptidase family A8 (signal peptidase II family, clan AC). The catalytic residues have not been identified, but three conserved aspartates can be identified from sequence alignments. Two aspartate residues have been shown by site-directed mutagenesis to be essential for activity (Tjalsma et al. (1999) *J. Biol. Chem.* 274:28191-28197). These occur in the motifs GNXXDRX (SEQ ID NO:143) and FNXAD (SEQ ID NO:144) where X is a hydrophobic residue. The type example is the *Escherichia coli* lipoprotein signal peptidase or SPase II (EC:3.4.23.36). This enzyme recognizes a conserved sequence and cuts in front of a cysteine residue to which a glyceride-fatty acid lipid is attached. SPase II is an integral membrane protein that is anchored in the membrane. Bacterial cell walls contain large amounts of murein lipoprotein, a small protein that is both N-terminally bound to lipid and attached to membrane peptidoglycan (murein) through the epsilon-amino group of its C-terminal lysine residue (Rawlings and Barrett, 1995, supra). Secretion of this lipoprotein is facilitated by the action of lipoprotein signal peptidase (also known as leader peptidase II), located in the inner membrane (Tokunaga et al. (1984) *J. Biol. Chem.* 259:3825-30; Rawlings and Barrett, 1995, supra). Methods to measure aspartic-type endopeptidase activity are well known in the art (see, for example, Tjalsma et al., 1999, supra).

Other Peptidases

The prolyl aminopeptidases of the present invention (SEQ ID NOS:2, 62, 72, and 128) are members of the alpha/beta hydrolase fold domain family (PFAM Accession No. PF00561). The alpha/beta hydrolase fold (Ollis et al. (1992) *Protein Eng.* 5:197-211) is common to a number of hydrolytic enzymes of widely differing phylogenetic origin and catalytic function. The core of each enzyme is an alpha/beta-sheet (rather than a barrel), containing eight beta-sheets connected by alpha-helices (Ollis et al., 1992, supra). The enzymes are believed to have diverged from a common ancestor, preserving the arrangement of the catalytic residues. All have a catalytic triad, the elements of which are borne on loops, which are the best conserved structural features of the fold.

SEQ ID NO:82 is a member of the ATPase family associated with various cellular activities (AAA) (PFAM Accession No. PF00004). AAA family proteins often perform chaperone-like functions that assist in the assembly, operation, or disassembly of protein complexes (Confalonieri and Duguet (1995) *Bioessays* 17:639-50). A key feature of this family is that the members share a conserved region of about 220 amino acids that contains an ATP-binding site. The proteins that belong to this family either contain one or two AAA domains. It is proposed that, in general, the AAA domains in these proteins act as ATP-dependent protein clamps (Confalonieri and Duguet, 1995, supra). In addition to the ATP-binding 'A' and 'B' motifs, which are located in the N-terminal half of this domain, there is a highly conserved region located in the central part of the domain.

SEQ ID NOS:74, 76, 80, 92, and 130 are members of the CAAX (SEQ ID NO: 150) amino terminal protease family (PFAM Accession No. PF02517). These proteins contain a highly conserved Glu-Glu motif at the amino end of the alignment. The alignment also contains two histidine residues that may be involved in zinc binding.

SEQ ID NOS:78 and 132 are members of the Patatin-like phospholipase family (PFAM Accession No. PF01734). This family consists of various patatin glycoproteins from plants. The patatin protein accounts for up to 40% of the total soluble protein in potato tubers (Banfalvi et al. (1994) *Mol. Gen. Genet.* 245:517-22). Patatin is a storage protein but it also has the enzymatic activity of lipid acyl hydrolase, catalyzing the cleavage of fatty acids from membrane lipids (Banfalvi et al., 1994, supra). Members of this family have been found also in vertebrates.

SEQ ID NO:96 is a member of the YSIRK (SEQ ID NO: 153) type signal peptide family (PFAM Accession No. PF04650). Many surface proteins found in *Streptococcus, Staphylococcus*, and related lineages share apparently homologous signal sequences. A motif resembling [YF]SIxxxGxxS[VIA] (SEQ ID NO: 145) appears at the start of the transmembrane domain. The GxxS motif appears perfectly conserved, suggesting a specific function and not just homology. There is a strong correlation between proteins carrying this region at the N-terminus and those carrying the Gram-positive anchor domain with the LPXTG (SEQ ID NO: 135) sortase processing site at the C-terminus.

SEQ ID NO:122 is a member of the amidohydrolase family (PFAM Accession No. PF01979). This family of enzymes comprises a large metal dependent hydrolase superfamily whose members catalyze the hydrolysis of various bonds. Methods to measure hydrolase activity are well known in the art (see, for example, Park et al. (2004) *Arch. Biochem. Biophys.* 429:224-30).

The following examples are offered by way of illustration and not by way of limitation.

EXPERIMENTAL

EXAMPLE 1

Gapped BlastP Results for Amino Acid Sequences

A Gapped BlastP sequence alignment showed that SEQ ID NO:2 (293 amino acids) has about 88% identity from amino acids 1-293 with a protein from *Lactobacillus helveticus* that is a proline iminopeptidase (PIP) (prolyl aminopeptidase) (PAP) (Accession No. sp|P52278|PIP_LACHE), about 61% identity from amino acids 1-293 with a protein from *Lactobacillus delbrueckii* that is a proline iminopeptidase (PIP) (prolyl aminopeptidase) (PAP) (Accession No. sp|P46542|PIP_LACDL), about 61% identity from amino acids 1-293 with a protein from *Lactobacillus delbrueckii* that is a proline iminopeptidase (Accession Nos. gb|AAA61596.1; L10712), about 61% identity from amino acids 1-293 with a protein from *Lactobacillus delbrueckii* that is a proline iminopeptidase (PIP) (prolyl aminopeptidase) (PAP) (Accession No. sp|P46544|PIP_LACDE), and about 63% identity from amino acids 1-269 with a protein from *Lactobacillus delbrueckii* that is a prolyl aminopeptidase (EC 3.4.11.5) (Accession No. pir||S44282).

A Gapped BlastP sequence alignment showed that SEQ ID NO:4 (658 amino acids) has about 62% identity from amino acids 11-658 with a protein from *Lactobacillus helveticus* that is an endopeptidase O2 (Accession Nos. gb|AAL73136.1; AF321529), about 59% identity from amino acids 9-658 with a protein from *Lactobacillus helveticus* that is a neutral endopeptidase (Endopeptidase O) (Accession No. sp|O52071|PEPO_LACHE), about 44% identity from amino acids 29-658 with a protein from *Lactococcus lactis* subsp. *lactis* that is a neutral endopeptidase (Accession Nos. NP_267960.1; NC_002662), about 44% identity from amino acids 29-658 with a protein from *Lactococcus lactis* subsp. *lactis* that is a p endopeptidase PepO (EC 3.4.-.-) (Accession No. pir||F53290), and about 44% identity from amino acids 29-658 with a protein from *Lactococcus lactis* subsp. *cremoris* that is a neutral endopeptidase (endopeptidase O) (Accession No. sp|Q09145|PEPO_LACLC).

A Gapped BlastP sequence alignment showed that SEQ ID NO:6 (200 amino acids) has about 60% identity from amino acids 1-198 with a protein from *Lactococcus lactis* subsp. *cremoris* that is a pyrrolidone carboxyl peptidase (Accession Nos. emb|CAA11699.1; AJ223962), about 60% identity from amino acids 1-198 with a protein from *Lactococcus lactis* subsp. *cremoris* that is a pyrrolidone-carboxylate peptidase (5-oxoprolyl-peptidase) (Accession No. sp|O87765|PCP_LACLC), about 52% identity from amino acids 1-199 with a protein from *Streptococcus pneumoniae* that is a pyrrolidone-carboxylate peptidase (Accession Nos. NP_345348.1; NC_003028), about 52% identity from amino acids 1-199 with a protein from *Streptococcus pyogenes* that is homologous to a pyrrolidone carboxyl peptidase (Accession Nos. NP_606760.1; NC_003485), and about 52% identity from amino acids 1-199 with a protein from *Streptococcus pyogenes* that is homologous to a pyrrolidone carboxyl peptidase (Accession Nos. NP_268785.1; NC_002737).

A Gapped BlastP sequence alignment showed that SEQ ID NO:8 (124 amino acids) has about 55% identity from amino acids 10-118 with a protein from *Lactobacillus delbrueckii* that is an aminopeptidase G (Accession No. sp|P94869|PEPG_LACDL), about 55% identity from amino acids 10-118 with a protein from *Lactobacillus helveticus* that is an aminopeptidase E (Accession No. sp|P94870|PEPE_LACHE), about 51% identity from amino acids 10-118 with a protein from *Lactobacillus delbrueckii* that is an aminopeptidase W (Accession No. sp|P94868|PEPW_LACDL), about 44% identity from amino acids 10-118 with a protein from *Lactobacillus delbrueckii* that is an aminopeptidase C (bleomycin hydrolase) (Accession No. sp|Q48543|PEPC_LACDL), and about 45% identity from amino acids 10-118 with a protein from *Lactobacillus helveticus* that is an aminopeptidase C (bleomycin hydrolase) (Accession No. sp|Q10744|PEPC_LACHE).

A Gapped BlastP sequence alignment showed that SEQ ID NO:9 (306 amino acids) has about 53% identity from amino acids 6-306 with a protein from *Lactobacillus helveticus* that is an aminopeptidase E (Accession No. sp|P94870|PEPE_LACHE), about 51% identity from amino acids 7-306 with a protein from *Lactobacillus delbrueckii* that is an aminopeptidase G (Accession No. sp|P94869|PEPG_LACDL), about 50% identity from amino acids 6-305 with a protein from *Lactobacillus delbrueckii* that is an aminopeptidase W (Accession No. sp|P94868|PEPW_LACDL), about 43% identity from amino acids 4-305 with a protein from *Lactobacillus helveticus* that is an aminopeptidase C (bleomycin hydrolase) (Accession No. sp|Q10744|PEPC_LACHE), and about 43% identity from amino acids 4-305 with a protein from *Lactobacillus delbrueckii* that is an aminopeptidase C (bleomycin hydrolase) (Accession No. sp|Q48543|PEPC_LACDL).

A Gapped BlastP sequence alignment showed that SEQ ID NO:11 (445 amino acids) has about 91% identity from amino acids 8-445 with a protein from *Lactobacillus helveticus* that is an aminopeptidase E (Accession No. sp|P94870|PEPE_LACHE), about 72% identity from amino acids 8-445 with a protein from *Lactobacillus delbrueckii* that is an aminopeptidase G (Accession No. sp|P94869|PEPG_LACDL), about 61% identity from amino acids 8-444 with a protein from *Lactobacillus delbrueckii* that is an aminopeptidase W (Accession No. sp|P94868|PEPW_LACDL), about 41% identity from amino acids 8-444 with a protein from *Lactobacillus delbrueckii* that is an aminopeptidase C (bleomycin hydrolase) (Accession No. sp|Q48543|PEPC_LACDL), and about 42% identity from amino acids 8-429 with a protein from *Lactobacillus helveticus* that is an aminopeptidase C (bleomycin hydrolase) (Accession Nos. gb|AAA25250.1; L26223).

A Gapped BlastP sequence alignment showed that SEQ ID NO:13 (194 amino acids) has about 95% identity from amino acids 1-194 with a protein from *Lactobacillus helveticus* that is a dipeptidase (Accession Nos. emb|CAA86210.1; Z38063), about 95% identity from amino acids 1-194 with a protein from *Lactobacillus helveticus* that is a dipeptidase A (Accession No. sp|Q48558|PEDA_LACHE), about 45% identity from amino acids 2-194 with a protein from *Lactococcus lactis* subsp. *lactis* that is a dipeptidase (Accession Nos. NP_267714.1; NC_002662), about 42% identity from amino acids 2-194 with a protein from *Lactococcus lactis* subsp. *lactis* that is a dipeptidase (Accession Nos. NP_266408.1; NC_002662), and about 41% identity from amino acids 2-194 with a protein from *Streptococcus pyogenes* that is homologous to a dipeptidase (Accession Nos. NP_606948.1; NC_003485).

A Gapped BlastP sequence alignment showed that SEQ ID NO:15 (280 amino acids) has about 93% identity from amino acids 1-252 with a protein from *Lactobacillus helveticus* that is a dipeptidase (Accession Nos. emb|CAA86210.1; Z38063), about 93% identity from amino acids 1-252 with a protein from *Lactobacillus helveticus* that is a dipeptidase A (Accession No. sp|Q48558|PEDA_LACHE), about 61% identity from amino acids 2-251 with a protein from *Lactococcus lactis* subsp. *lactis* that is a dipeptidase (Accession Nos. NP_267714.1; NC_002662), about 65% identity from amino acids 6-252 with a protein from *Lactococcus lactis* subsp. *lactis* that is a dipeptidase (Accession Nos. NP_266408.1; NC_002662), and about 54% identity from amino acids 1-252 with a protein from *Streptococcus pyogenes* that is homologous to a dipeptidase (Accession Nos. NP_606948.1; NC_003485).

A Gapped BlastP sequence alignment showed that SEQ ID NO:17 (229 amino acids) has about 38% identity from amino acids 30-113 with a protein from *Caulobacter crescentus* that is a prepilin peptidase (Accession Nos. NP_419003.1; NC_002696), about 27% identity from amino acids 1-198 with a protein from *Clostridium perfringens* that is homologous to a prepilin peptidase (Accession Nos. NP_563203.1; NC_003366), about 27% identity from amino acids 4-219 with a protein from *Thermotoga maritima* that is a type IV prepilin peptidase (Accession Nos. NP_229496.1; NC_000853), about 32% identity from amino acids 6-115 with a protein from *Aquifex aeolicus* that is a type 4 prepilin peptidase (Accession Nos. NP_214100.1; NC_000918), and about 24% identity from amino acids 36-226 with a protein from *Escherichia coli* that is a prepilin peptidase (Accession Nos. gb|AAL10690.1; AY056599).

A Gapped BlastP sequence alignment showed that SEQ ID NO:19 (449 amino acids) has about 90% identity from amino acids 1-449 with a protein from *Lactobacillus helveticus* that is an aminopeptidase C (bleomycin hydrolase) (Accession No. sp|Q10744|PEPC_LACHE), about 90% identity from amino acids 1-434 with a protein from *Lactobacillus helveticus* that is an aminopeptidase C (Accession Nos. gb|AAA25250.1; L262236), about 76% identity from amino acids 1-449 with a protein from *Lactobacillus delbrueckii* that is an aminopeptidase C (bleomycin hydrolase) (Accession No. sp|Q48543|PEPC_LACDL), about 51% identity from amino acids 5-446 with a protein from *Streptococcus thermophilus* that is an aminopeptidase C (bleomycin hydrolase) (Accession No. sp|Q56115|PEPC_STRTR), and about 52% identity from amino acids 23-446 with a protein from *Streptococcus pyogenes* that is homologous to a cysteine aminopeptidase C (Accession Nos. NP_269696.1; NC_002737).

A Gapped BlastP sequence alignment showed that SEQ ID NO:21 (244 amino acids) has about 40% identity from amino acids 1-182 with a hypothetical protein from *Enterococcus faecalis* (Accession Nos. emb|CAA76861.1; Y17797), about 32% identity from amino acids 1-244 with a protein from *Streptococcus pyogenes* that is homologous to a glycoprotein endopeptidase (Accession Nos. NP_607937.1; NC_003485), about 33% identity from amino acids 1-244 with a protein from *Streptococcus pyogenes* that is homologous to a glycoprotein endopeptidase (Accession Nos. NP_269867.1; NC_002737), about 32% identity from amino acids 1-234 with a conserved hypothetical protein from *Streptococcus pneumoniae* (Accession Nos. NP_357723.1; NC_003098), and about 30% identity from amino acids 1-234 with a conserved hypothetical protein from *Streptococcus pneumoniae* (Accession Nos. NP_344673.1; NC_003028).

A Gapped BlastP sequence alignment showed that SEQ ID NO:23 (349 amino acids) has about 57% identity from amino acids 5-339 with a protein from *Streptococcus pneumoniae* that is a secreted metalloendopeptidase Gcp (Accession Nos. NP_357725.1; NC_003098), about 57% identity from amino acids 5-339 with a protein from *Streptococcus pneumoniae* that is a glycoprotease family protein (Accession Nos. NP_344675.1; NC_003028), about 56% identity from amino acids 4-341 with a protein from *Listeria monocytogenes* that is homologous to a glycoprotein endopeptidase (Accession Nos. NP_465599.1; NC_003210), about 56% identity from amino acids 4-341 with a protein from *Listeria innocua* that is homologous to a glycoprotein endopeptidase (Accession Nos. NP_471514.1; NC_003212), and about 56% identity from amino acids 6-339 with a protein from *Streptococcus pyogenes* that is homologous to a glycoprotein endopeptidase (Accession Nos. NP_607935.1; NC_003485).

A Gapped BlastP sequence alignment showed that SEQ ID NO:25 (368 amino acids) has about 92% identity from amino acids 1-368 with a protein from *Lactobacillus helveticus* that is a Xaa-Pro dipeptidase (X-Pro dipeptidase) (proline dipeptidase) (Accession No. sp|O84913|PEPQ_LACHE), about 73% identity from amino acids 1-368 with a protein from *Lactobacillus delbrueckii* that is a Xaa-Pro (X-Pro dipeptidase) (proline depeptidase) (Accession No. sp|P46545|PEPQ_LACDL), about 73% identity from amino acids 1-368 with a protein from *Lactobacillus delbrueckii* subsp. *bulgaricus* that is an Xaa-Pro dipeptidase (X-Pro dipeptidase) (Proline dipeptidase) (Accession No. sp|Q9S6S1|PEPQ_LACDE), about 72% identity from amino acids 1-368 with a protein from *Lactobacillus delbrueckii* that is a prolidase (Accession Nos. emb|CAB07978.1; Z93944), and about 57% identity from amino acids 3-366 with a protein from *Lactobacillus pentosus* that is a PepQ (Accession Nos. gb|AAD53120.1; AF176799).

A Gapped BlastP sequence alignment showed that SEQ ID NO:27 (275 amino acids) has about 52% identity from amino acids 1-261 with a protein from *Listeria innocua* that is homologous to a methionine aminopeptidase (Accession Nos. NP_471156.1; NC_003212), about 50% identity from amino acids 1-261 with a protein from *Listeria monocytogenes* that is homologous to a methionine aminopeptidase (Accession Nos. NP_465234.1; NC_003210), about 47% identity from amino acids 1-257 with a protein from *Streptococcus pneumoniae* that is a methionine aminopeptidase, type I (Accession Nos. NP_345557.1; NC_003028), about 45% identity from amino acids 1-257 with a protein from *Lactococcus lactis* subsp. *lactis* that is a methionine aminopeptidase (Accession Nos. NP_266768.1; NC_002662), and about 44% identity from amino acids 1-257 with a protein from *Streptococcus pyogenes* that is homologous to a methionine aminopeptidase (Accession Nos. NP_269461.1; NC_002737).

A Gapped BlastP sequence alignment showed that SEQ ID NO:29 (437 amino acids) has about 64% identity from amino acids 7-436 with a protein from *Lactobacillus helveticus* that is a aminopeptidase E (Accession No. sp|P94870|PEPE_LACHE), about 63% identity from amino acids 7-436 with a protein from *Lactobacillus delbrueckii* that is an aminopeptidase G (Accession No. sp|P94869|PEPG_LACDL), about 55% identity from amino acids 4-436 with a protein from *Lactobacillus delbrueckii* that is an aminopeptidase W (Accession No. sp|P94868|PEPW_LACDL), about 42% identity from amino acids 4-437 with a protein from *Lactobacillus delbrueckii* that is an aminopeptidase C (bleomycin hydrolase) (Accession No. sp|Q48543|PEPC_LACDL), and about 42% identity from amino acids 4-418 with a protein from *Lactobacillus helveticus* that is an aminopeptidase C (Accession Nos. gb|AAA25250.1; L26223).

A Gapped BlastP sequence alignment showed that SEQ ID NO:31 (467 amino acids) has about 86% identity from amino acids 1-467 with a protein from *Lactobacillus helveticus* that is a carnosinase (Accession Nos. gb|AAC24967.1; AF012085), about 73% identity from amino acids 1-466 with a protein from *Lactobacillus delbrueckii* that is an Xaa-His dipeptidase (X-His dipeptidase) (Aminoacyl-histidine) (Accession No. sp|P45494|PEPV_LACDL), about 47% identity from amino acids 3-465 with a protein from *Streptococcus pyogenes* that is homologous to a dipeptidase (Accession Nos. NP_269236.1; NC_002737), about 47% identity from amino acids 3-465 with a protein from *Streptococcus pyogenes* that is homologous to a dipeptidase (Accession Nos. NP_607175.1; NC_003485), and about 46% identity from amino acids 3-449 with a protein from *Streptococcus pneumoniae* that is a dipeptidase (Accession Nos. NP_345135.1; NC_003028).

A Gapped BlastP sequence alignment showed that SEQ ID NO:33 (167 amino acids) has about 49% identity from amino acids 17-156 with a protein from *Streptococcus pyogenes* that is homologous to a prolipoprotein signal peptidase (Accession Nos. NP_269038.1; NC_002737), about 49% identity from amino acids 17-156 with a protein from *Streptococcus pyogenes* that is homologous to a prolipoprotein signal peptidase (Accession Nos. NP_607041.1; NC_003485), about 43% identity from amino acids 15-165 with a protein from *Lactococcus lactis* subsp. *lactis* that is a lipoprotein signal peptidase (EC 3.4.23.36) (Accession Nos. NP_267153.1;

NC_002662), about 40% identity from amino acids 20-157 with a protein from *Streptococcus pneumoniae* that is a lipoprotein signal peptidase (Accession Nos. NP_345412.1; NC_003028), and about 37% identity from amino acids 15-165 with a protein from *Lactococcus lactis* subsp. *cremoris* that is a lipoprotein signal peptidase (prolipoprotein signal peptidase) (Accession No. sp|Q48729|LSPA_LACLC).

A Gapped BlastP sequence alignment showed that SEQ ID NO:37 (415 amino acids) has about 93% identity from amino acids 1-413 with a protein from *Lactobacillus helveticus* that is a tripeptidase (Accession Nos. emb|CAB72938.1; AJ243321), about 55% identity from amino acids 1-413 with a protein from *Lactococcus lactis* that is a peptidase T (aminotripeptidase) (tripeptidase) (Accession No. sp|P42020|PEPT_LACLC), about 55% identity from amino acids 1-410 with a protein from *Lactococcus lactis* subsp. *lactis* that is a tripeptidase (Accession Nos. NP_267967.1; NC_002662), about 53% identity from amino acids 1-402 with a protein from *Streptococcus pneumoniae* that is a aminotripeptidase (tripeptidase) (Accession Nos. NP_358507.1; NC_003098), and about 53% identity from amino acids 1-402 with a protein from *Streptococcus pneumoniae* that is a peptidase T (Accession Nos. NP_345484.1; NC_003028).

A Gapped BlastP sequence alignment showed that SEQ ID NO:39 (647 amino acids) has about 85% identity from amino acids 1-647 with a protein from *Lactobacillus helveticus* that is a neutral endopeptidase (endopeptidase O) (Accession No. sp|O52071|PEPO_LACHE), about 57% identity from amino acids 7-647 with a protein from *Lactobacillus helveticus* that is an endopeptidase O2 (Accession Nos. gb|AAL73136.1; AF321529), about 39% identity from amino acids 24-647 with a protein from *Lactococcus lactis* subsp. *lactis* that is an endopeptidase PepO (EC 3.4.-.-) (Accession No. pir||F53290), about 38% identity from amino acids 24-647 with a protein from *Lactococcus lactis* subsp. *lactis* that is a neutral endopeptidase (Accession Nos. NP_267960.1; NC_002662), and about 37% identity from amino acids 24-647 with a protein from *Streptococcus pneumoniae* that is an endopeptidase O (Accession Nos. NP_359084.1; NC_003098).

A Gapped BlastP sequence alignment showed that SEQ ID NO:41 (208 amino acids) has about 61% identity from amino acids 9-204 with a protein from *Bacillus subtilis* that is a transcriptional regulator (Accession Nos. NP_389668.1; NC_000964), about 58% identity from amino acids 9-205 with a protein from *Listeria innocua* that is homologous to an SOS response regulator (lexA) (Accession Nos. NP_470676.1; NC_003212), about 57% identity from amino acids 9-205 with a protein from *Listeria monocytogenes* that is homologous to an SOS response regulator (lexA) (Accession Nos. NP_464827.1; NC_003210), about 59% identity from amino acids 9-204 with a protein from *Staphylococcus aureus* that is a LexA repressor (Accession No. sp|Q9L4P1|LEXA_STAAU), and about 59% identity from amino acids 9-204 with a protein from *Staphylococcus aureus* that is a LexA protein (Accession Nos. gb|AAK52314.1; AY033082).

A Gapped BlastP (version) sequence alignment showed that SEQ ID NO:43 (487 amino acids) has about 50% identity from amino acids 17-487 with a protein from *Lactobacillus sakei* that is homologous to a dipeptidase (Accession No. sp|Q48841|PEPD_LACSK), about 41% identity from amino acids 20-485 with a protein from *Lactococcus lactis* subsp. *lactis* that is a dipeptidase (Accession Nos. NP_267714.1; NC_002662), about 42% identity from amino acids 21-483 with a protein from *Lactobacillus helveticus* that is a dipeptidase (Accession Nos. emb|CAA86210.1; Z38063), 42% identity from amino acids 21-483 with a protein from *Lactobacillus helveticus* that is a dipeptidase A (Accession No. sp|Q48558|PEDA_LACHE) and 38% identity from amino acids 20-485 with a protein from *Streptococcus pyogenes* that is homologous to a dipeptidase (Accession Nos. NP_606948.1; NC_003485).

A Gapped BlastP sequence alignment showed that SEQ ID NO:45 (369 amino acids) has about 40% identity from amino acids 13-366 with a protein from *Bacillus halodurans* that is a Xaa-Pro dipeptidase (Accession Nos. NP_243666.1; NC_002570), about 41% identity from amino acids 13-363 with a protein from *Thermotoga maritima* that is homologous to an aminopeptidase P (Accession Nos. NP_227858.1; NC_000853), about 41% identity from amino acids 13-367 with a protein from *Staphylococcus aureus* subsp. *aureus* that is an Xaa-Pro dipeptidase (Accession Nos. NP_374643.1; NC_002745), about 37% identity from amino acids 14-367 with a protein from *Bacillus subtilis* that is homologous to an Xaa-Pro dipeptidase (Accession Nos. NP_390326.1; NC_000964), and about 38% identity from amino acids 13-367 with a protein from *Listeria innocua* that is homologous to an aminopeptidase P (Accession Nos. NP_470727.1; NC_003212).

A Gapped BlastP sequence alignment showed that SEQ ID NO:47 (193 amino acids) has about 28% identity from amino acids 3-193 with a protein from *Bacillus halodurans* that is an aryldialkylphosphatase (Accession Nos. NP_243801.1; NC_002570), about 31% identity from amino acids 49-193 with a protein from *Methanothermobacter thermautotrophicus* that is homologous to an aryldialkylphosphatase (Accession Nos. NP_276647.1; NC_000916), about 35% identity from amino acids 49-193 with a protein from *Caulobacter crescentus* that is homologous to an Xaa-Pro dipeptidase (Accession Nos. NP_421471.1; NC_002696), about 30% identity from amino acids 32-193 with a protein from *Sulfolobus solfataricus* that is an prolidase (Xaa-Pro dipeptidase) (Accession Nos. NP_343867.1; NC_002754), and about 30% identity from amino acids 18-193 with a protein from *Sulfolobus solfataricus* that is a prolidase (Xaa-Pro dipeptidase) (Accession Nos. NP_343436.1; NC_002754).

A Gapped BlastP sequence alignment showed that SEQ ID NO:48 (198 amino acids) has about 36% identity from amino acids 3-186 with a protein from *Caulobacter crescentus* that is homologous to an Xaa-Pro dipeptidase (Accession Nos. NP_419119.1; NC_002696), about 37% identity from amino acids 2-185 with a protein from *Caulobacter crescentus* that is homologous to an Xaa-Pro dipeptidase (Accession Nos. NP_421471.1; NC_002696), about 33% identity from amino acids 1-198 with a protein from *Bacillus halodurans* that is an aryldialkylphosphatase (Accession Nos. NP_243801.1; NC_002570), about 37% identity from amino acids 2-188 with a protein from *Caulobacter crescentus* that is homologous to an Xaa-Pro dipeptidase (Accession Nos. NP_421919.1; NC_002696), and about 35% identity from amino acids 2-195 with a protein from *Sulfolobus solfataricus* that is a prolidase (Xaa-Pro dipeptidase) (Accession Nos. NP_343867.1; NC_002754).

A Gapped BlastP sequence alignment showed that SEQ ID NO:50 (793 amino acids) has about 69% identity from amino acids 1-793 with a protein from *Lactobacillus delbrueckii* subsp. *lactis* that is an Xaa-Pro dipeptidyl-peptidase (X-Pro dipeptidyl-peptidase) (Accession No. sp|P40334|PEPX_LACDL), about 68% identity from amino acids 7-793 with a protein from *Lactobacillus delbrueckii* that is an X-prolyl dipeptidyl aminopeptidase (Accession Nos. emb|CAB38074.1; AJ012302), about 91% identity from amino acids 1-793 with a protein from *Lactobacillus helveticus* that is a PepX protein (Accession Nos. gb|AAB50275.1; U22900), about 91% identity from amino acids 1-793 with a protein from *Lactobacillus helveticus* that is an X-prolyl dipeptidyl aminopeptidase (Accession Nos. emb|CAA88273.1; Z48236), and about 40% identity from amino acids 1-788 with a protein from *Lactobacillus rhamnosus* that is an X-Pro dipeptidyl-peptidase (EC 3.4.14.11) (Accession No. pir|| T46737).

A Gapped BlastP sequence alignment showed that SEQ ID NO:52 (1627 amino acids) has about 30% identity from amino acids 364-979 with a protein from *Lactococcus lactis* subsp. *cremoris* that is a PrtP precursor (Accession No. gb|AAK27981.1; AF247159), about 30% identity from amino acids 350-979 with a protein from *Lactobacillus paracasei* that is an PII-type proteinase precursor (lactocepin) (cell wall-associated serine proteinase) (Accession No. sp|Q02470|P2P_LACPA), about 30% identity from amino acids 350-979 with a protein from *Lactococcus lactis* subsp. *cremoris* that is a PII-type proteinase precursor (lactocepin) (cell wall-associated serine proteinase) (Accession No. sp|P15293|P2P_LACLC), about 30% identity from amino acids 350-979 with a protein from *Lactococcus lactis* subsp. *cremoris* that is a PI-type proteinase precursor (cell wall-associated serine proteinase) (Accession No. sp|P16271|P1P_LACLC), and about 30% identity from amino acids 350-979 with a protein from *Lactococcus lactis* subsp. *cremoris* that is a lactocepin (EC 3.4.21.96) precursor (Accession No. pir||B45764).

A Gapped BlastP sequence alignment showed that SEQ ID NO:54 (427 amino acids) has about 48% identity from amino acids 9-408 with a protein from *Fusobacterium nucleatum* subsp. *nucleatum* that is a peptidase T (Accession Nos. NP_603630.1; NC_003454), about 44% identity from amino acids 11-408 with a protein from *Clostridium acetobutylicum* that is a peptidase T (aminotripeptidase) (Accession Nos. NP_347116.1; NC_003030), about 45% identity from amino acids 6-408 with a protein from *Clostridium perfringens* that is homologous to an aminotripeptidase (Accession Nos. NP_560941.1; NC_003366), about 45% identity from amino acids 9-408 with a protein from *Streptococcus pneumoniae* that is an aminotripeptidase (tripeptidase) (Accession Nos. NP_358507.1; NC_003098), and about 45% identity from amino acids 9-407 with a protein from *Streptococcus pneumoniae* that is a peptidase T (Accession Nos. NP_345484.1; NC_003028).

A Gapped BlastP sequence alignment showed that SEQ ID NO:56 (510 amino acids) has about 31% identity from amino acids 127-376 with a protein from *Streptomyces coelicolor* that is homologous to a metallopeptidase (Accession Nos. emb|CAC16707.1; AL450289), about 24% identity from amino acids 235-484 with a protein from *Rattus norvegicus* that is a leucyl-specific aminopeptidase PILS (Accession Nos. NP_110463.1; NM_030836), about 22% identity from amino acids 287-498 with a protein from *Xylella fastidiosa* that is an aminopeptidase N (Accession Nos. NP_298777.1; NC_002488), about 24% identity from amino acids 235-484 with a protein from *Rattus norvegicus* that is an aminopeptidase PILS (Accession Nos. gb|AAF73106.1; AF148323), and about 25% identity from amino acids 306-495 with a protein from *Caenorhabditis elegans* that is a peptidase (Accession Nos. NP 502335.1; NM_069934).

A Gapped BlastP sequence alignment showed that SEQ ID NO:58 (432 amino acids) has about 39% identity from amino acids 5-430 with a protein from *Bacillus subtilis* that is a D-alanyl-D-alanine carboxypeptidase (penicillin-binding protein) (Accession Nos. NP_387891.1; NC_000964), about 37% identity from amino acids 46-430 with a protein from *Bacillus stearothermophilus* that is a D-alanyl-D-alanine carboxypeptidase precursor (DD-peptidase) (Accession No. sp|Q05523|DACA_BACST), about 34% identity from amino acids 8-389 with a protein from *Bacillus halodurans* that is a serine-type D-Ala-D-Ala carboxypeptidase (Accession Nos. NP_240887.1; NC_002570), about 40% identity from amino acids 56-430 with a protein from *Bacillus subtilis* that is a penicillin binding protein (Accession No. pir||I39830), and about 37% identity from amino acids 12-382 with a protein from *Lactococcus lactis* subsp. *lactis* that is a D-alanyl-D-alanine carboxypeptidase (Accession Nos. NP_268420.1; NC_002662).

A Gapped BlastP sequence alignment showed that SEQ ID NO:60 (475 amino acids) has about 45% identity from amino acids 6-475 with a protein from *Lactobacillus sakei* that is homologous to a dipeptidase (Accession No. sp|Q48841|PEPD_LACSK), about 42% identity from amino acids 2-473 with a protein from *Lactococcus lactis* subsp. *lactis* that is a dipeptidase (Accession No. NP_267714.1; NC_002662), about 39% identity from amino acids 6-473 with a protein from *Lactococcus lactis* subsp. *lactis* that is a dipeptidase (Accession Nos. NP_266408.1; NC_002662), about 37% identity from amino acids 1-473 with a protein from *Streptococcus pyogenes* that is homologous to a dipeptidase (Accession Nos. NP_606948.1; NC_003485), and about 37% identity from amino acids 1-473 with a protein from *Streptococcus pyogenes* that is homologous to a dipeptidase (Accession Nos. NP_268945.1; NC_002737).

A Gapped BlastP sequence alignment showed that SEQ ID NO:62 (305 amino acids) has about 96% identity from amino acids 1-304 with a protein from *Lactobacillus helveticus* that is a prolinase (Accession Nos. gb|AAA19050.1; U05214), about 96% identity from amino acids 1-304 with a protein from *Lactobacillus helveticus* that is a prolyl aminopeptidase (EC 3.4.11.5) (Accession No. pir||B59088), about 96% identity from amino acids 1-302 with a protein from *Lactobacillus helveticus* that is a prolinase (Accession No. pir||S47276), about 67% identity from amino acids 1-301 with a protein from *Lactobacillus rhamnosus* that is a prolinase (Accession Nos. emb|CAA06029.1; AJ003247), and about 50% identity from amino acids 5-273 with a protein from *Lactobacillus delbrueckii* that is a leucyl aminopeptidase (Accession No. pir||S52201).

A Gapped BlastP sequence alignment showed that SEQ ID NO:64 (598 amino acids) has about 49% identity from amino acids 3-598 with a protein from *Bacillus licheniformis* that is a thimet oligopeptidase (EC 3.4.24.15) (Accession No. pir||T44581), about 49% identity from amino acids 3-598 with a protein from *Bacillus subtilis* that is homologous to an oligoendopeptidase (Accession Nos. NP_389036.1; NC_000964), about 51% identity from amino acids 6-598 with a protein from *Streptococcus pneumoniae* that is a group B oligopeptidase (Accession Nos. NP_358476.1; NC_003098), about 51% identity from amino acids 6-598 with a protein from *Streptococcus pneumoniae* that is an oligoendopeptidase F (Accession Nos. NP_345460.1; NC_003028), and about 49% identity from amino acids 6-598 with a protein from *Lactococcus lactis* that is a oligoendopeptidase F (Accession No. sp|P54124|PEF1_LACLC).

A Gapped BlastP sequence alignment showed that SEQ ID NO:66 (473 amino acids) has about 39% identity from amino acids 12-473 with a protein from *Lactobacillus sakei* that is homologous to a dipeptidase (Accession No. sp|Q48841|PEPD_LACSK), about 35% identity from amino acids 11-470 with a protein from *Lactococcus lactis* subsp. *lactis* that is a dipeptidase (Accession Nos. NP_267714.1;

NC_002662), about 34% identity from amino acids 13-470 with a protein from *Lactococcus lactis* subsp. *lactis* that is a dipeptidase (Accession Nos. NP_266408.1; NC_0026628), about 34% identity from amino acids 9-469 with a protein from *Streptococcus pyogenes* that is homologous to a dipeptidase (Accession Nos. NP_606948.1; NC_003485), and about 34% identity from amino acids 9-469 with a protein from *Streptococcus pyogenes* that is homologous to a dipeptidase (Accession Nos. NP_268945.1; NC_002737).

A Gapped BlastP sequence alignment showed that SEQ ID NO:68 (844 amino acids) has about 91% identity from amino acids 1-844 with a protein from *Lactobacillus helveticus* that is a membrane alanyl aminopeptidase (EC 3.4.11.2) (Accession No. pir||S47274), about 91% identity from amino acids 1-844 with a protein from *Lactobacillus helveticus* that is an aminopeptidase N (lysyl aminopeptidase) (Accession No. sp|Q10730|AMPN_LACHE), about 71% identity from amino acids 1-832 with a protein from *Lactobacillus delbrueckii* that is an aminopeptidase N (lysyl aminopeptidase) (Accession No. sp|P37896|AMPN_LACDL), about 49% identity from amino acids 1-839 with a protein from *Lactococcus lactis* that is an aminopeptidase N (lysyl aminopeptidase) (Accession No. sp|P37897|AMPN_LACLC), and about 49% identity from amino acids 1-839 with a protein from *Lactococcus lactis* subsp. *cremoris* that is a lysine aminopeptidase (EC 3.4.11.-) (Accession No. pir||JNO324).

A Gapped BlastP sequence alignment showed that SEQ ID NO:70 (210 amino acids) has about 33% identity from amino acids 15-208 with a protein from *Staphylococcus aureus* that is a type-1 signal peptidase 1B (Accession Nos. NP_371489.1; NC_002758), about 35% identity from amino acids 21-209 with a protein from *Listeria monocytogenes* that is homologous to a signal peptidase I (Accession Nos. NP_464796.1; NC_003210), about 32% identity from amino acids 5-209 with a protein from *Staphylococcus carnosus* that is a type-I signal peptidase SipB (Accession Nos. gb|AAD09011.1; AF089862), about 33% identity from amino acids 1-208 with a protein from *Clostridium acetobutylicum* that is a signal peptidase I (Accession Nos. NP_349253.1; NC_003030), and about 34% identity from amino acids 9-210 with a protein from *Lactococcus lactis* subsp. *lactis* that is a signal peptidase I (EC 3.4.21.89) (Accession Nos. NP_268415.1; NC_002662).

A Gapped BlastP sequence alignment showed that SEQ ID NO:72 (301 amino acids) has about 73% identity from amino acids 3-270 with a protein from *Lactobacillus delbrueckii* that is a leucyl aminopeptidase (Accession No. pir||S52201), about 52% identity from amino acids 6-298 with a protein from *Lactobacillus rhamnosus* that is a prolinase (Accession Nos. emb|CAA06029.1; AJ003247), about 51% identity from amino acids 6-301 with a protein from *Lactobacillus helveticus* that is a prolyl aminopeptidase (EC 3.4.11.5) (Accession No. pir||B59088), about 51% identity from amino acids 6-301 with a protein from *Lactobacillus helveticus* that is a prolinase (Accession Nos. gb|AAA19050.1; U05214), and about 51% identity from amino acids 6-301 with a protein from *Lactobacillus helveticus* that is a prolinase (Accession No. pir||S47276).

A Gapped BlastP sequence alignment showed that SEQ ID NO:74 (485 amino acids) has about 29% identity from amino acids 101-476 with a protein from *Lactobacillus gasseri* that is homologous to a metal-dependent membrane protease (Accession No. ref|ZP_00047041.1), about 28% identity from amino acids 101-482 with a protein from *Lactobacillus johnsonii* (Accession No. ref|NP_964632.1), about 26% identity from amino acids 120-485 with a protein from *Lactobacillus gasseri* that is homologous to a metal-dependent membrane protease (Accession No. ref|ZP_00046861.1), about 29% identity from amino acids 98-478 with a protein from *Lactobacillus johnsonii* (Accession No. ref|NP_965449.1), and about 26% identity from amino acids 141-475 with a protein from *Lactobacillus plantarum* that is a membrane-bound protease, CAAX family (Accession No. ref|NP_786255.1).

A Gapped BlastP sequence alignment showed that SEQ ID NO:76 (264 amino acids) has about 23% identity from amino acids 115-231 with a protein from *Clostridium acetobutylicum* that is homologous to a CAAX-like membrane endopeptidase (Accession Nos. NP_149219.1; NC_001988), about 29% identity from amino acids 78-260 with a protein from *Lactobacillus plantarum* that is a PlnI protein (Accession Nos. emb|CAA64208.1; X94434), about 21% identity from amino acids 17-217 with a protein from *Clostridium acetobutylicum* that is homologous to a CAAX-like membrane endopeptidase (Accession Nos. NP_347123.1; NC_003030), about 29% identity from amino acids 116-218 with a protein from *Streptomyces coelicolor* that is homologous to a transmembrane protein (Accession No. pir||T34651), and about 25% identity from amino acids 39-217 with a putative protein from *Arabidopsis thaliana* (Accession Nos. NP_568928.1; NM_125468).

A Gapped BlastP sequence alignment showed that SEQ ID NO:78 (286 amino acids) has about 41% identity from amino acids 5-284 with a protein from *Fusobacterium nucleatum* subsp. *nucleatum* that is a serine protease (Accession Nos. NP_603405.1; NC_003454), about 38% identity from amino acids 5-284 with a protein from *Pasteurella multocida* (Accession Nos. NP_245575.1; NC_002663), about 34% identity from amino acids 8-284 with a protein from *Clostridium acetobutylicum* that is homologous to a phosphoesterase (Accession Nos. NP_349039.1; NC_003030), about 50% identity from amino acids 9-269 with a conserved hypothetical protein from *Clostridium perfringens* (Accession Nos. NP_562255.1; NC_003366), and about 29% identity from amino acids 9-284 with a putative protein from *Corynebacterium glutamicum* that is homologous to an esterase of the alpha-beta hydrolase superfamily (Accession Nos. NP_600371.1; NC_003450).

A Gapped BlastP sequence alignment showed that SEQ ID NO:80 (402 amino acids) has about 25% identity from amino acids 257-392 with a protein from *Lactobacillus plantarum* that is a PlnI protein (Accession Nos. emb|CAA64208.1; X94434), about 24% identity from amino acids 150-337 with a protein from *Clostridium acetobutylicum* that is homologous to a CAAX-like membrane endopeptidase (Accession Nos. NP_149219.1; NC_001988), about 26% identity from amino acids 237-339 with a protein from *Yersinia pestis* that is homologous to a membrane protein (Accession Nos. NP_404750.1; NC_003143), about 28% identity from amino acids 225-339 with a conserved hypothetical protein from *Clostridium perfringens* (Accession Nos. NP_561049.1; NC_003366), and about 24% identity from amino acids 261-333 with a protein from *Lactobacillus plantarum* that is a PlnP protein (Accession Nos. emb|CAA64202.1; X94434).

A Gapped BlastP sequence alignment showed that SEQ ID NO:82 (728 amino acids) has about 62% identity from amino acids 1-728 with a protein from *Lactococcus lactis* subsp. *lactis* that is an ATP-dependent protease ATP-binding subunit (Accession Nos. NP_266713.1; NC_002662), about 62% identity from amino acids 1-728 with a protein from *Lactococcus lactis* that is an ATP-dependent clp protease ATP-binding subunit clpE (Accession No. sp|Q9S5Z2|CLPE_LACLC), about 60% identity from amino acids 1-719 with a protein from *Streptococcus pyogenes* that is homologous to an ATP-dependent protease (Accession Nos. NP_607597.1; NC_003485), about 60% identity from amino acids 1-719 with a protein from *Streptococcus pyogenes* that is homologous to an ATP-dependent protease (Accession Nos. NP_269585.1; NC_002737), and about 60% identity from amino acids 1-713 with a protein from *Streptococcus pneumoniae* that is an ATP dependent protease (Accession Nos. NP_358319.1; NC_003098).

A Gapped BlastP sequence alignment showed that SEQ ID NO:84 (410 amino acids) has about 21% identity from amino acids 5-350 with a hypothetical protein from *Staphylococcus aureus* subsp. *aureus* (Accession Nos. NP_371802.1; NC_002758), about 21% identity from amino acids 11-373 with a conserved protein from *Bacillus halodurans* (Accession Nos. NP_243259.1; NC_002570), about 21% identity from amino acids 16-373 with a conserved hypothetical protein from *Streptococcus pneumoniae* (Accession Nos. NP_359621.1; NC_003098), about 25% identity from amino acids 127-352 with a protein from *Mesorhizobium loti* that is a processing protease (Accession Nos. NP_107814.1; NC_002678), and about 21% identity from amino acids 16-373 with a conserved hypothetical protein from *Streptococcus pneumoniae* (Accession Nos. NP_346633.1; NC_003028).

A Gapped BlastP sequence alignment showed that SEQ ID NO:86 (417 amino acids) has about 28% identity from amino acids 26-393 with a protein from *Lactococcus lactis* subsp. *lactis* that is a protease (Accession Nos. NP_268129.1; NC_002662), about 27% identity from amino acids 2-367 with a conserved hypothetical protein from *Streptococcus pneumoniae* (Accession Nos. NP_359620.1; NC_003098), about 25% identity from amino acids 6-414 with a protein from *Streptococcus pneumoniae* that is a peptidase (Accession Nos. NP_346632.1; NC_003028), about 25% identity from amino acids 13-327 with a protein from *Bacillus subtilis* that is homologous to a processing protease (Accession Nos. NP_389568.1; NC_000964), and about 31% identity from amino acids 1-200 with a hypothetical protein from *Staphylococcus aureus* subsp. *aureus* (Accession Nos. NP_371803.1; NC_002758).

A Gapped BlastP sequence alignment showed that SEQ ID NO:88 (197 amino acids) has about 39% identity from amino acids 76-130 with a protein from *Homo sapiens* that is homologous to a YME1-like protein (Accession Nos. XP_064907.1; XM_064907), about 35% identity from amino acids 80-156 with a protein from *Lactobacillus plantarum* that is a PlnI protein (Accession Nos. emb|CAA64208.1; X94434), about 31% identity from amino acids 59-156 with a protein from *Lactobacillus plantarum* that is a PlnP protein (Accession Nos. emb|CAA64202.1; X94434), about 39% identity from amino acids 29-98 with a protein from *Arabidopsis thaliana* (Accession Nos. NP_182197.1; NM_130240), and about 37% identity from amino acids 78-130 with a protein from *Homo sapiens* that is homologous to a YME1-like 1 protein (Accession Nos. gb|AAH07795.1; AAH07795; BC007795).

A Gapped BlastP sequence alignment showed that SEQ ID NO:90 (398 amino acids) has about 35% identity from amino acids 256-360 with a protein from *Lactobacillus plantarum* that is a PlnP protein (Accession Nos. emb|CAA64202.1; X94434), and about 25% identity from amino acids 279-350 with a protein from *Arabidopsis thaliana* (Accession Nos. NP_565483.1; NM_127637).

A Gapped BlastP sequence alignment showed that SEQ ID NO:92 (217 amino acids) has about 24% identity from amino acids 2-216 with a conserved hypothetical protein from *Streptococcus pneumoniae* (Accession Nos. NP_357859.1; NC_003098), about 25% identity from amino acids 5-216 with a conserved hypothetical protein from *Streptococcus pneumoniae* (Accession Nos. NP_344826.1; NC_003028), about 29% identity from amino acids 77-216 with a hypothetical protein from *Streptococcus pneumoniae* (Accession Nos. NP_358420.1; NC_003098), about 29% identity from amino acids 77-216 with a conserved hypothetical protein from *Streptococcus pneumoniae* (Accession Nos. NP_345409.1; NC_003028), and about 31% identity from amino acids 90-217 with a conserved domain protein from *Streptococcus pneumoniae* (Accession Nos. NP_346535.1; NC_003028).

A Gapped BlastP sequence alignment showed that SEQ ID NO:94 (180 amino acids) has about 30% identity from amino acids 53-173 with a protein from *Lactobacillus helveticus* that is a cell envelope-associated proteinase (PrtH) (Accession Nos. gb|AAD50643.1; AF133727), about 26% identity from amino acids 40-172 with a protein from *Lactobacillus helveticus* that is a surface layer protein (Accession Nos. emb|CAB46990.1; AJ388564), about 26% identity from amino acids 40-172 with a protein from *Lactobacillus helveticus* that is a surface layer protein (Accession Nos. emb|CAB46988.1; AJ388562), about 26% identity from amino acids 40-172 with a protein from *Lactobacillus helveticus* that is a surface layer protein (Accession Nos. emb|CAA63409.1; X92752), and about 26% identity from amino acids 40-172 with a protein from *Lactobacillus helveticus* that is a surface layer protein (Accession Nos. emb|CAB46986.1; AJ388560).

A Gapped BlastP sequence alignment showed that SEQ ID NO:96 (66 amino acids) has about 47% identity from amino acids 13-52 with a protein from *Streptococcus thermophilus* that is a cell envelope proteinase (Accession Nos. gb|AAG09771.1; AF243528), about 47% identity from amino acids 17-58 with a protein from *Streptococcus gordonii* that is a surface-associated protein cshA precursor (Accession No. pir||S61441), about 51% identity from amino acids 18-66 with a protein from *Staphylococcus aureus* that is a biofilm-associated surface protein (Accession Nos. gb|AAK38834.1; AF288402), about 53% identity from amino acids 18-59 with a protein from *Staphylococcus aureus* that is a bone sialoprotein-binding protein (Accession Nos. emb|CAB75732.1; Y18653), and about 66% identity from amino acids 18-41 with a protein from *Staphylococcus epidermidis* that is an accumulation-associated protein (Accession Nos. emb|CAB77251.1; AJ249487).

A Gapped BlastP sequence alignment showed that SEQ ID NO:98 (466 amino acids) has about 50% identity from amino acids 3-466 with a protein from *Lactobacillus plantarum* that is a dipeptidase (Accession No. ref|NP_784672.1), about 49% identity from amino acids 3-466 with a protein from *Lactococcus lactis* subsp. *lactis* that is a dipeptidase (Accession No. ref|NP_267714.1), about 49% identity from amino acids 3-466 with a protein from *Pediococcus pentosaceus* that is a dipeptidase (Accession No. ref|ZP_00322734.1), about 53% identity from amino acids 3-438 with a protein from *Oenococcus oeni* that is a dipeptidase (Accession No. ref|ZP_00319585.1), and about 50% identity from amino acids 3-466 with a protein from *Lactobacillus helveticus* that is a dipeptidase (Accession No. emb|CAA86210.1).

A Gapped BlastP sequence alignment showed that SEQ ID NO:100 (298 amino acids) has about 72% identity from amino acids 1-298 with a protein from *Lactobacillus johnsonii* that is homologous to a protease htpX-like protein (Accession No. ref|NP_964092.1), about 72% identity from amino acids 1-298 with a protein from *Lactobacillus gasseri* that is a Zn-dependent protease with chaperone function (Accession No. refIZP_00047067.1), about 58% identity from amino acids 1-298 with a protein from *Lactobacillus plantarum* that is a cell surface zinc metalloproteinase (Accession No. refINP_784296.1), about 59% identity from amino acids 1-298 with a protein from *Pediococcus pentosaceus* that is a Zn-dependent protease with chaperone function (Accession No. refIZP_00323762.1), and about 56% identity from amino acids 1-298 with a protein from *Leuconostoc mesenteroides* subsp. *mesenteroides* that is a Zn-dependent protease with chaperone function (Accession No. refIZP_00063838.1).

A Gapped BlastP sequence alignment showed that SEQ ID NO:102 (360 amino acids) has about 91% identity from amino acids 1-358 with a protein from *Lactobacillus johnsonii* (Accession No. refINP_964579.1), about 46% identity from amino acids 1-356 with a protein from *Enterococcus faecalis* that is a peptidase, M42 family (Accession No. refINP_816356.1), about 32% identity from amino acids 9-352 with a protein from *Staphylococcus epidermidis* that is an endo-1,4-beta-glucanase (Accession No. refINP_765585.1), about 32% identity from amino acids 5-358 with a protein from *Symbiobacterium thermophilum* that is an endo-1,4-beta-glucanase (Accession No. refIYP_076504.1), and about 33% identity from amino acids 5-358 with a protein from *Listeria monocytogenes* that is homologous to a peptidase (Accession No. refIYP_013825.1).

A Gapped BlastP sequence alignment showed that SEQ ID NO:104 (383 amino acids) has about 62% identity from amino acids 9-382 with a protein from *Pediococcus pentosaceus* that is a Metal-dependent amidase/aminoacylase/carboxypeptidase (Accession No. refIZP_00323382.1), about 58% identity from amino acids 3-381 with a protein from *Lactobacillus plantarum* that is an amino acid amidohydrolase (Accession No. refINP_785749.1), about 56% identity from amino acids 3-382 with a protein from *Oenococcus oeni* that is a Metal-dependent amidase/aminoacylase/carboxypeptidase (Accession No. refIZP_00319187.1), about 50% identity from amino acids 4-382 with a protein from *Leuconostoc mesenteroides* subsp. *mesenteroides* that is a Metal-dependent amidase/aminoacylase/carboxypeptidase (Accession No. refIZP_00063246.1), and about 52% identity from amino acids 4-378 with a protein from *Enterococcus faecalis* that is a peptidase, M20/M25/M40 family (Accession No. refINP_814864.1).

A Gapped BlastP sequence alignment showed that SEQ ID NO:106 (180 amino acids) has about 43% identity from amino acids 5-180 with a protein from *Lactobacillus johnsonii* (Accession No. refINP_964990.1), about 41% identity from amino acids 25-180 with a protein from *Lactobacillus gasseri* that is homologous to a membrane protein (Accession No. refIZP_00046788.2), about 40% identity from amino acids 41-175 with a protein from *Lactobacillus helveticus* (Accession No. dbjIBAC00953.1), about 41% identity from amino acids 6-180 with a protein from *Lactobacillus johnsonii* (Accession No. refINP_964071.1), and about 38% identity from amino acids 23-180 with a protein from *Lactobacillus plantarum* that is a lipoprotein precursor (Accession No. refINP_785142.1).

A Gapped BlastP sequence alignment showed that SEQ ID NO:108 (202 amino acids) has about 43% identity from amino acids 12-202 with a protein from *Lactobacillus gasseri* that is homologous to a membrane protein (Accession No. refIZP_00046788.2), about 39% identity from amino acids 2-202 with a protein from *Lactobacillus johnsonii* (Accession No. refINP_964071.1), about 32% identity from amino acids 2-202 with a protein from *Enterococcus faecalis* that is homologous to a lipoprotein (Accession No. refINP_816666.1), about 40% identity from amino acids 50-202 with a protein from *Lactobacillus johnsonii* (Accession No. refINP_964990.1), and about 32% identity from amino acids 60-196 with a protein from *Lactobacillus helveticus* (Accession No. dbjIBAC00953.1).

A Gapped BlastP sequence alignment showed that SEQ ID NO:110 (193 amino acids) has about 53% identity from amino acids 1-193 with a protein from *Lactobacillus helveticus* (Accession No. dbjIBAC00953.1), about 30% identity from amino acids 16-193 with a protein from *Lactobacillus gasseri* that is homologous to a membrane protein (Accession No. refIZP_00046788.2), about 37% identity from amino acids 54-193 with a protein from *Lactobacillus johnsonii* (Accession No. refINP_964071.1), about 33% identity from amino acids 42-193 with a protein from *Lactobacillus johnsonii* (Accession No. refINP_964990.1), and about 29% identity from amino acids 43-193 with a protein from *Lactobacillus plantarum* that is a lipoprotein precursor (Accession No. refINP_785142.1).

A Gapped BlastP sequence alignment showed that SEQ ID NO:112 (300 amino acids) has about 71% identity from amino acids 1-296 with a protein from *Lactobacillus johnsonii* that is a protease maturation protein precursor (Accession No. refINP_965480.1), about 72% identity from amino acids 1-296 with a protein from *Lactobacillus gasseri* that is a Parvulin-like peptidyl-prolyl isomerase (Accession No. refIZP_00046709.1), about 52% identity from amino acids 5-299 with a protein from *Pediococcus pentosaceus* that is a Parvulin-like peptidyl-prolyl isomerase (Accession No. refIZP_00323213.1), about 50% identity from amino acids 1-299 with a protein from *Lactobacillus lactis* subsp. *cremoris* (Accession No. emblCAA32349.1), and about 49% identity from amino acids 1-299 with a protein from *Lactococcus lactis* subsp. *cremoris* that is a PrtM precursor (Accession No. gbIAAK27980.1).

A Gapped BlastP sequence alignment showed that SEQ ID NO:114 (437 amino acids) has about 92% identity from amino acids 1-437 with a protein from *Lactobacillus helveticus* that is an endopeptidase E2 (Accession No. gbIAAQ72431.1), about 82% identity from amino acids 1-437 with a protein from *Lactobacillus johnsonii* that is an aminopeptidase C (Accession No. refINP_964192.1), about 82% identity from amino acids 1-437 with a protein from *Lactobacillus gasseri* that is an aminopeptidase C (Accession No. refIZP_00047232.2), about 57% identity from amino acids 1-437 with a protein from *Lactobacillus gasseri* that is an aminopeptidase C (Accession No. refIZP_00047230.1), and about 56% identity from amino acids 1-437 with a protein from *Lactobacillus johnsonii* that is an aminopeptidase C (Accession No. refINP_964194.1).

A Gapped BlastP sequence alignment showed that SEQ ID NO:116 (650 amino acids) has about 74% identity from amino acids 7-650 with a protein from *Lactobacillus gasseri* that is homologous to a metalloendopeptidase (Accession No. refIZP_00046938.1), about 73% identity from amino acids 5-650 with a protein from *Lactobacillus johnsonii* that is an endopeptidase O (Accession No. refINP_964163.1), about 73% identity from amino acids 5-650 with a protein from *Lactobacillus helveticus* that is an endopeptidase O3 (Accession No. gbIAAQ72429.1), about 62% identity from amino acids 3-650 with a protein from *Lactobacillus helveticus* that is an endopeptidase O2 (Accession No. gbIAAL73136.1), and about 59% identity from amino acids 1-650 with a protein from *Lactobacillus helveticus* that is an endopeptidase O (Accession No. gbIAAC35997.1).

A Gapped BlastP sequence alignment showed that SEQ ID NO:118 (438 amino acids) has about 91% identity from amino acids 1-438 with a protein from *Lactobacillus helveticus* that is an endopeptidase (Accession No. gb|AAB52540.1), about 72% identity from amino acids 1-438 with a protein from *Lactobacillus delbrueckii* that is a cysteine aminopeptidase (Accession No. emb|CAA96465.1), about 70% identity from amino acids 1-438 with a protein from *Lactobacillus gasseri* that is an aminopeptidase C (Accession No. ref|ZP_00047230.1), about 69% identity from amino acids 1-438 with a protein from *Lactobacillus johnsonii* that is an aminopeptidase C (Accession No. ref|NP_964194.1), and about 63% identity from amino acids 5-437 with a protein from *Lactobacillus johnsonii* that is an aminopeptidase C (Accession No. ref|NP_965376.1).

A Gapped BlastP (version) sequence alignment showed that SEQ ID NO:120 (473 amino acids) has about 85% identity from amino acids 1-473 with a protein from *Lactobacillus gasseri* that is a dipeptidase (Accession No. ref|ZP_00047305.1), about 85% identity from amino acids 1-473 with a protein from *Lactobacillus johnsonii* that is a dipeptidase (Accession No. ref|NP_965320.1), about 58% identity from amino acids 6-473 with a protein from *Pediococcus pentosaceus* that is a dipeptidase (Accession No. ref|ZP_00323606.1), 57% identity from amino acids 6-473 with a protein from *Lactobacillus plantarum* that is a dipeptidase (Accession No. ref|NP_784146.1) and 50% identity from amino acids 3-473 with a protein from *Pediococcus pentosaceus* that is a dipeptidase (Accession No. ref|ZP_00323346.1).

A Gapped BlastP sequence alignment showed that SEQ ID NO:122 (193 amino acids) has about 40% identity from amino acids 3-190 with a protein from *Leuconostoc mesenteroides* subsp. *mesenteroides* that is in the Imidazolonepropionase and related amidohydrolases COG1228 (Accession No. ref|ZP_00063494.1), about 39% identity from amino acids 2-189 with a protein from *Lactobacillus plantarum* (Accession No. ref|NP_786871.1), about 41% identity from amino acids 9-175 with a protein from *Oceanobacillus iheyensis* that is homologous to an aryldialkylphosphatase (Accession No. ref|NP_691226.1), about 37% identity from amino acids 3-181 with a protein from *Caulobacter crescentus* that is homologous to an Xaa-Pro dipeptidase (Accession No. ref|NP_419119.1), and about 34% identity from amino acids 4-193 with a protein from *Bacillus halodurans* that is an aryldialkylphosphatase (Accession No. ref|NP_243801.1).

A Gapped BlastP sequence alignment showed that SEQ ID NO:124 (505 amino acids) has about 27% identity from amino acids 3-481 with a protein from *Thermoanaerobacter tengcongensis* that is an aminopeptidase N (Accession No. ref|NP_624209.1), about 33% identity from amino acids 122-369 with a protein from *Streptomyces avermitilis* that is homologous to a metallopeptidase (Accession No. ref|NP_821429.1), about 31% identity from amino acids 122-371 with a protein from *Streptomyces coelicolor* that is homologous to a metallopeptidase (Accession No. ref|NP_631646.1), about 24% identity from amino acids 11-480 with a protein from *Chloroflexus aurantiacus* that is an aminopeptidase N (Accession No. ref|ZP_00358219.1), and about 23% identity from amino acids 122-468 with a protein from *Moorella thermoacetica* that is an aminopeptidase N (Accession No. ref|ZP_00329919.1).

A Gapped BlastP sequence alignment showed that SEQ ID NO:126 (470 amino acids) has about 76% identity from amino acids 3-470 with a protein from *Lactobacillus johnsonii* that is homologous to a dipeptidase (Accession No. ref|NP_965710.1), about 76% identity from amino acids 6-470 with a protein from *Lactobacillus gasseri* that is a dipeptidase (Accession No. ref|ZP_00046618.2), about 59% identity from amino acids 9-470 with a protein from *Lactobacillus johnsonii* (Accession No. ref|NP_964598.1), about 49% identity from amino acids 9-470 with a protein from *Lactobacillus plantarum* that is a dipeptidase (Accession No. ref|NP_785290.1), and about 48% identity from amino acids 66-470 with a protein from *Pediococcus pentosaceus* that is a dipeptidase (Accession No. ref|ZP_00323315.1).

A Gapped BlastP sequence alignment showed that SEQ ID NO:128 (299 amino acids) has about 73% identity from amino acids 1-268 with a protein from *Lactobacillus delbrueckii* that is a leucyl aminopeptidase (Accession No. emb|CAA84382.1), about 52% identity from amino acids 4-296 with a protein from *Lactobacillus plantarum* that is a prolyl aminopeptidase (Accession No. ref|NP_784587.1), about 52% identity from amino acids 4-296 with a protein from *Lactobacillus rhamnosus* that is a prolinase (Accession No. emb|CAA06029.1), about 50% identity from amino acids 4-297 with a protein from *Lactobacillus sakei* that is a PepR (Accession No. gb|AAM88886.1), and about 51% identity from amino acids 4-299 with a protein from *Lactobacillus helveticus* that is a prolinase (Accession No. emb|CAA83195.1).

A Gapped BlastP sequence alignment showed that SEQ ID NO:130 (252 amino acids) has about 31% identity from amino acids 15-249 with a protein from *Lactobacillus gasseri* that is homologous to a metal-dependent membrane protease (Accession No. ref|ZP_00047281.1), about 32% identity from amino acids 18-206 with a protein from *Lactobacillus johnsonii* (Accession No. ref|NP_964551.1), about 23% identity from amino acids 103-219 with a protein from *Clostridium acetobutylicum* that is homologous to a CAAX-like membrane endopeptidase (Accession No. ref|NP_149219.1), about 28% identity from amino acids 70-205 with a protein from *Oenococcus oeni* that is homologous to a metal-dependent membrane protease (Accession No. ref|ZP_00320199.1), and about 27% identity from amino acids 43-205 with a protein from *Methanosarcina barkeri* str. *fusaro* that is homologous to a metal-dependent membrane protease (Accession No. ref|ZP_00296469.1).

A Gapped BlastP sequence alignment showed that SEQ ID NO:132 (282 amino acids) has about 59% identity from amino acids 1-282 with a protein from *Lactobacillus johnsonii* (Accession No. ref|NP_964640.1), about 59% identity from amino acids 1-282 with a protein from *Lactobacillus gasseri* that is homologous to an esterase of the alpha-beta hydrolase superfamily (Accession No. ref|ZP_00045972.1), about 41% identity from amino acids 1-280 with a protein from *Streptococcus agalactiae* (Accession No. ref|NP_689045.1), about 41% identity from amino acids 1-280 with a protein from *Mannheimia succiniciproducens* that is an RssA protein (Accession No. ref|YP_087337.1), and about 41% identity from amino acids 1-280 with a protein from *Fusobacterium nucleatum* subsp. *vincentii* that is a serine protease (Accession No. ref|ZP_00143830.1).

A Gapped BlastP sequence alignment showed that SEQ ID NO: 134 (404 amino acids) has about 39% identity from amino acids 4-404 with a protein from *Lactobacillus johnsonii* (Accession No. ref|NP_964689.1), about 40% identity from amino acids 4-404 with a protein from *Lactobacillus gasseri* that is homologous to a Zn-dependent peptidase (Accession No. ref|ZP_00047325.1), about 19% identity from amino acids 26-403 with a protein from *Staphylococcus epidermidis* that is homologous to a processing proteinase-like protein (Accession No. ref|NP_764510.1), about 21% identity from amino acids 5-344 with a protein from *Staphylococcus aureus* subsp. *aureus* (Accession No. ref|YP_040665.1), and about 21% identity from amino acids 5-344 with a protein from *Staphylococcus aureus* subsp. *aureus* that is homologous to a processing proteinase (Accession No. ref|NP_645978.1).

A Gapped BlastP sequence alignment showed that SEQ ID NO: 147 (80 amino acids) has about 55% identity from amino acids 6-79 with a protein from *Lactobacillus johnsonii* that is a signal peptidase I (Accession No. ref|NP_965146.1), about 52% identity from amino acids 6-75 with a protein from *Lactobacillus gasseri* that is a signal peptidase I (Accession No. ref|ZP_00045871.1), about 52% identity from amino acids 7-75 with a protein from *Lactobacillus gasseri* that is a signal peptidase I (Accession No. ref|ZP_00047480.1), about 50% identity from amino acids 7-75 with a protein from *Lactobacillus johnsonii* that is a signal peptidase I (Accession No. ref|NP_965313.1), and about 31% identity from amino acids 3-79 with a protein from *Enterococcus faecalis* that is a signal peptidase I (Accession No. ref|NP_814596.1).

EXAMPLE 2

PFAM Results for Amino Acid Sequences

Table 4 shows the top PFAM results for the amino acid sequences of the invention.

All publications, patents and patent applications mentioned in the specification are indicative of the level of those skilled in the art to which this invention pertains. All publications, patents and patent applications are herein incorporated by reference to the same extent as if each individual publication, patent or patent application was specifically and individually indicated to be incorporated by reference.

Many modifications and other embodiments of the inventions set forth herein will come to mind to one skilled in the art to which these inventions pertain having the benefit of the teachings presented in the foregoing descriptions and the associated drawings. Therefore, it is to be understood that the inventions are not to be limited to the specific embodiments disclosed and that modifications and other embodiments are intended to be included within the scope of the appended embodiments. Although specific terms are employed herein, they are used in a generic and descriptive sense only and not for purposes of limitation.

TABLE 1

Proteinases of dairy lactic acid bacteria[a]

| Strain | MW[b] | Substrate | References[c] |
|---|---|---|---|
| *Lc. lactis* subsp. *cremoris* WG2 | 181 | κ-, β-casein | Kok et al. (1988) |
| *Lc. lactis* subsp. *cremoris* HP |  | κ-, β-casein | Exterkate and De Veer (1987a) |
| *Lc. lactis* subsp. *cremoris* SK11 | 187 | $\alpha_{s1}$-, κ-, β-casein | Vos et al. (1989) |
| *Lc. lactis* subsp. *cremoris* AC1 |  | $\alpha_{s1}$-, κ-, β-casein | Bockelmann et al. (1989) |
| *Lc. lactis* subsp. *cremoris* AM1 |  | $\alpha_{s1}$-, κ-, β-casein | Visser et al. (1991) |
| *Lc. lactis* subsp. *cremoris* H2 | 180 | κ-, β-casein | Coolbear et al. (1992) |
| *Lc. lactis* subsp. *cremoris* NCDO763 | 181 | $\alpha_{s1}$-, κ-, β-casein | Kiwaki et al. (1989) |
| *Lb. casei* subsp. *casei* HN1 |  | β-casein | Kojic et al. (1991) |
| *Lb. casei* subsp. *casei* NCDO 151 | 181 |  | Holck and Naes (1992) |
| *Lb. delbrueckii* subsp. *bulgaricus* CNRZ 397 | 170 | $\alpha_{s1}$-, β-casein | Laloi et al. (1991) |
| *Lb. helveticus* CNRZ 303 |  | $\alpha_{s1}$-, β-casein | Zevaco and Gripon (1988) |
| *Lb. helveticus* CP790 | 45 | $\alpha_{s1}$-, β-casein | Yamamoto et al. (1993) |
| *Lb. helveticus* L89 | 180 | $\alpha_{s1}$-, β-casein | Martin-Hernandez et al. (1994) |

[a]Source: Kunji et al. (1996a)
[b](kDa)
[c]Only key references are cited

TABLE 2

Peptidases of lactic acid bacteria[a]

| Peptidase | Strain | MW[b] | Structure | Class[c] | References |
|---|---|---|---|---|---|
| Glutamyl Aminopeptidase (PepA) | *Lc. lactis* | 40 | hexamer | M | Bacon et al. (1994) |
|  | *Lc. lactis* | 43 | trimer | M | Exterkate and De Veer (1987b) |
|  | *Lc. lactis* | 38 |  |  | l'Anson et al. (1995) |
|  | *Lc. lactis* | 41 | hexamer | M | Niven (1991) |
|  | *S. thermophilus* | 45 | octamer | M | Rul et al. (1995) |
| Cysteine Aminopeptidase (PepC) | *Lb. delbrueckii* | 54 | tetramer | C | Wohlrab and Bockelmann (1993) |
|  | *Lb. delbrueckii* | 51 |  | C | Klein et al. (1994a) |
|  | *Lb. helveticus* | 49 |  | C | Fernandez et al. (1994) |
|  | *Lb. helveticus* | 51 |  |  | Vesanto et al. (1994) |
|  | *Lb. helveticus* | 50 | tetramer | C | Fernandez de Palencia et al. (1997) |
|  | *Lc. lactis* | 50 | hexamer |  | Neviani et al. (1989) |
|  | *Lc. lactis* | 50 |  | C | Chapot-Chartier et al. (1993) |
|  | *Lc. lactis* | 50 | hexamer |  | Mistou et al. (1994) |
|  | *S. thermophilus* | 50 | hexamer | C | Chapot-Chartier et al. (1994) |
| Aminopeptidase (PepN) | *Lb. casei* | 95 | monomer | M | Fernandez de Palencia et al. (1997) |
|  | *Lb. casei* | 87 | monomer | M | Arora and Lee (1992) |
|  | *Lb. delbrueckii* | 98 | monomer | M | Tsakalidou et al. (1993) |
|  | *Lb. delbrueckii* | 95 |  | M | Bockelmann et al. (1992) |
|  | *Lb. delbrueckii* | 95 | monomer | M | Klein et al. (1993) |

TABLE 2-continued

Peptidases of lactic acid bacteria[a]

| Peptidase | Strain | MW[b] | Structure | Class[c] | References |
|---|---|---|---|---|---|
| | Lb. helveticus | 97 | monomer | M | Khalid and Marth (1990a) |
| | Lb. helveticus | 96 | | M | Christensen et al. (1995b) |
| | Lb. helveticus | 97 | monomer | M | Blanc et al. (1993) |
| | Lb. helveticus | 92 | monomer | M | Miyakawa et al. (1992) |
| | Lb. helveticus | 95 | monomer | M | Sasaki et al. (1996) |
| | Lb. helveticus | 96 | | M | Varmanen et al. (1994) |
| | Lb. lactis | 78 | monomer | M | Eggimann and Bachmann (1980) |
| | Lb. rhamnosus | 89 | monomer | M | Arora and Lee (1994) |
| | Lb. sanfranciso | 75 | monomer | M | Gobbetti et al. (1996) |
| | Lc. lactis | 95 | | M | Exterkate et al. (1992) |
| | Lc. lactis | 95 | monomer | M | Van Alen-Boerrigter et al. (1991) |
| | Lc. lactis | 95 | | M | Stroman (1992) |
| | Lc. lactis | 95 | monomer | M | Tan and Konings (1990) |
| | Lc. lactis | 95 | | M | Tan et al. (1992) |
| | Lc. lactis | 85 | | M | Desmazeaud and Zevaco (1979) |
| | S. thermophilus | 92 | monomer | M | Tsakalidou and Kalantzopoulos (1992) |
| | S. thermophilus | 97 | monomer | M | Rul et al. (1994) |
| | S. thermophilus | 98 | monomer | M | Midwinter and Pritchard (1994) |
| | S. thermophilus | 89 | monomer | M | Tsakalidou et al. (1993) |
| Aminopeptidase (PepS) | S. thermophilus | 45 | monomer | M | Fernandez-Espla and Rul (1999) |
| X-Prolyl- | Lb. acidophilus | 95 | dimer | S | Bockelmann et al. (1991) |
| Dipeptidyl | Lb. casei | 79 | monomer | S | Habibi-Najafi and Lee (1994) |
| Aminopeptidase | Lb. curvatus | 98 | dimer | | Magboul and McSweeney (2000) |
| (PepXP) | Lb. delbrueckii | 95 | dimer | S | Bockelmann et al. (1991) |
| | Lb. delbrueckii | 82 | | S | Atlan et al. (1990) |
| | Lb. delbrueckii | 90 | trimer | S | Miyakawa et al. (1991) |
| | Lb. delbrueckii | 88 | monomer | S | Meyer-Barton et al. (1993) |
| | Lb. helveticus | 72 | monomer | S | Khalid and Marth (1990b) |
| | Lb. helveticus | 90 | | | Yuksel and Steele (1996) |
| | Lb. helveticus | 87 | monomer | S | Miyakawa et al. (1994) |
| | Lb. helveticus | 91 | dimer | S | Vesanto et al. (1995) |
| | Lb. rhamnosus | | | | Varmanen et al. (2000) |
| | Lc. lactis | 90 | dimer | S | Meyer and Jordi (1987) |
| | Lc. lactis | 117 | | S | Booth et al. (1990b) |
| | Lc. lactis | 88 | dimer | | Chich et al. (1995) |
| | Lc. lactis | 88 | | | Nardi et al. (1991) |
| | Lc. lactis | 85 | dimer | S | Zevaco et al. (1990) |
| | Lc. lactis | 88 | dimer | S | Yan et al. (1991) |
| | Lc. lactis | 90 | dimer | S | Kiefer-Partsch et al. (1989) |
| | Lc. lactis | 88 | | | Mayo et al. (1991) |
| | Lc. lactis | 82 | dimer | S | Lloyd and Pritchard (1991) |
| | S. thermophilus | 80 | dimer | S | Tsakalidou et al. (1998) |
| | S. thermophilus | 80 | dimer | S | Meyer and Jordi (1987) |
| Aminopeptidase | Lc. lactis | 43 | monomer | M | Mars and Monnet (1995) |
| (PepP) | Lc. lactis | 46 | | M | Matos et al. (1998) |
| Iminopeptidase | Lb. delbrueckii | 33 | | S | Atlan et al. (1994) |
| (PepI) | Lb. delbrueckii | 34 | trimer | S | Gilbert et al. (1994) |
| | Lb. delbrueckii | 33 | | S | Klein et al. (1994b) |
| | Lb. helveticus | 34 | dimer | S | Varmanen et al. (1996a) |
| | Lc. lactis | 50 | dimer | M | Baankreis and Exterkate (1991) |
| Prolidase (PepQ) | Lb. casei | 41 | monomer | M | Fernandez-Espla and Martin-Hernandez (1997) |
| | Lb. delbrueckii | 41 | dimer | | Morel et al. (1999) |
| | Lb. delbrueckii | 41 | | M | Rantanen and Palva (1997) |
| | Lb. delbrueckii | 41 | | M | Stucky et al. (1995) |
| | Lb. helveticus | 41 | | | Yuksel and Steele (1997a) |
| | Lc. lactis | 42 | | M | Booth et al. (1990a) |
| | Lc. lactis | 43 | | M | Kaminogawa et al. (1984) |
| Prolinase | Lb. helveticus | 35 | | | Dudley and Steele (1994) |
| (PepR) | Lb. helveticus | 33 | tetramer | S | Shao et al. (1997) |
| | Lb. helveticus | 35 | | | Varmanen et al. (1996b) |
| | Lb. rhamnosus | 34 | | | Varmanen et al. (1998) |
| | Lb. curvatus | 32 | dimer | | Magboul and McSweeney (1998) |
| Dipeptidase | Lb. helveticus | 53 | | | Dudley et al. (1996) |
| (Pep D) | Lb. helveticus | 53 | octamer | C | Vesanto et al. (1996) |
| (PepV) | Lb. casei | 46 | monomer | M | Fernandez-Espla and Martin-Hernandez (1997) |
| | Lb. delbrueckii | 51 | monomer | M | Wohlrab and Bockelmann (1992) |
| | Lb. delbrueckii | 52 | monomer | M | Vongerichten et al. (1994) |
| | Lb. helveticus | 51 | | | Yuksel and Steele (1997b) |
| | Lb. helveticus | 50 | | M | Tan et al. (1995) |
| | Lb. sake | 50 | monomer | | Montel et al. (1995) |
| | Lb. sanfrancisco | 65 | monomer | | Gobbetti et al. (1996) |
| | Lc. lactis | 100 | | M | Hwang et al. (1981) |

TABLE 2-continued

Peptidases of lactic acid bacteria[a]

| Peptidase | Strain | MW[b] | Structure | Class[c] | References |
|---|---|---|---|---|---|
| | Lc. lactis | 51 | | M | Hellendoorn et al. (1997) |
| | Lc. lactis | 49 | monomer | M | Van Boven et al. (1988) |
| | Lc. lactis | 50 | | M | Desmazeaud and Zevaco (1977) |
| Tripeptidase (PepT) | Lc. lactis | 55 | dimer | M | Bacon et al. (1994) |
| | Lc. lactis | 46 | | | Mierau et al. (1994) |
| | Lc. lactis | 52 | dimer | M | Bosman et al. (1990) |
| Unclassified | Lb. delbrueckii | 29 | trimer | M | Bockelmann et al. (1995) |
| | Lb. delbrueckii | 38 | dimer | M | Bockelmann et al. (1997) |
| | Lb. sake | 55 | monomer | M | Sanz and Toldra (1998) |
| | Lc. lactis | 23 | trimer | | Sahlstrom et al. (1993) |
| | Lc. lactis | 75 | | M | Desmazeaud and Zevaco (1979) |
| | P. pentosaceus | 45 | dimer | M | Simitsopoulou et al. (1997) |
| Endopeptidase (PepO) | Lb. helveticus | 71 | | M | Chen and Steele (1998) |
| | Lc. lactis | 71 | | M | Lian et al. (1996) |
| | Lc. lactis | 71 | | M | Mierau et al. (1993) |
| | Lc. lactis | 70 | monomer | M | Pritchard et al. (1994) |
| | Lc. lactis | 71 | | | Tynkkynen et al. (1993) |
| (PepE) | Lb. helveticus | 52 | | C | Fenster et al. (1997) |
| (PepF1) | Lc. lactis | 70 | monomer | M | Monnet et al. (1994) |
| | Lc. lactis | 70 | | | Nardi et al. (1997) |
| (PepF2) | Lc. lactis | 70 | | | Nardi et al. (1997) |
| Unclassified | Lb. delbrueckii | 68 | monomer | M | Bockelmann et al. (1996) |
| | Lb. paracasei | 30 | multimer | M | Tobiassen et al. (1997) |
| | Lc. lactis | 98 | monomer | M | Yan et al. (1987) |
| | Lc. lactis | 180 | multimer | M | Baankreis et al. (1995) |
| | Lc. lactis | 40 | dimer | M | Yan et al. (1987) |
| | Lc. lactis | 70 | monomer | M | Baankreis et al. (1995) |
| | Lc. lactis | 70 | monomer | M | Stepaniak and Fox (1995) |
| | Lc. lactis | 52 | multimer | M | Stepaniak et al. (1998) |
| | Lc. lactis | 93 | | M | Muset et al. (1989) |
| | Lc. lactis | 70 | monomer | M | Tan et al. (1991b) |
| | Lc. lactis | 140 | | M | Ohmiya and Sato (1975) |
| | Lc. lactis | 50 | | M | Desmazeaud and Zevaco (1976) |

[a]Source: Christensen et al. (1999)
[b](kDa)
[c]C—cysteine-peptidase; M—metallopeptidase; S—serine-peptidase

TABLE 3

Proteases/Peptidases of the Present Invention

| SEQ ID NO: | ORF NO. | FUNCTION | COG |
|---|---|---|---|
| 1, 2 | 92 | Prolyl aminopeptidase (EC 3.4.11.5) | 0596 |
| 3, 4 | 165 | Neutral endopeptidase (EC 3.4.-.-) | 3590 |
| 5, 6 | 186 | Pyrrolidone carboxyl peptidase (EC 3.4.19.3) | 2039 |
| 7, 8, 9 | 194,195 | Aminopeptidase G | 3579 |
| 10, 11 | 204 | Aminopeptidase E | 3579 |
| 12, 13 | 235 | Dipeptidase (EC 3.4.13.18) | 4690 |
| 14, 15 | 236 | Dipeptidase (EC 3.4.13.18) | 4690 |
| 16, 17 | 286 | Prepilin peptidase (EC 3.4.99.-) | 1989 |
| 18, 19 | 343 | Aminopeptidase C | 3579 |
| 20, 21 | 388 | Glycoprotein endopeptidase | 1214 |
| 22, 23 | 390 | Endopeptidase (EC 3.4.24.57) | 0533 |
| 24, 25 | 430 | Xaa-pro dipeptidase (EC 3.4.13.9) | 0006 |
| 26, 27 | 623 | Methionine aminopeptidase (ampM) (EC 3.4.11.18) | 0024 |
| 28, 29 | 911 | Aminopeptidase | 3579 |
| 30, 31 | 994 | Aminoacyl-histidine dipeptidase (PepD) (EC 3.4.13.3) | 0624 |
| 32, 33 | 1152 | Lipoprotein signal peptidase A (LspA) (EC3.4.23.36) | 0597 |
| 34, 35 | 1182 | Peptidase | |
| 36, 37 | 1190 | Amino tripeptidase T (EC 3.4.11.-) | 2195 |
| 38, 39 | 1275 | Neutral endopeptidase O (PepO) (EC 3.4.-.-) | 3590 |
| 40, 41 | 1280 | Transcriptional repressor | 1974 |
| 42, 43 | 1294 | Dipeptidase (EC 3.4.13.18) | 4690 |
| 44, 45 | 1336 | X-Pro dipeptidase (EC 3.4.13.9) | 0006 |
| 46, 47, 48 | 1344,1343 | Aryldialkylphosphatase (PepQ) | 1228 |
| 49, 50 | 1373 | X-Pro dipeptidyl-peptidase (PepX) (EC 3.4.14.11) | |
| 51, 52 | 1512 | PrtP | 1404 |
| 53, 54 | 1515 | Peptidase T | 2195 |
| 55, 56 | 1567 | Aminopeptidase | 0308 |
| 57, 58 | 1603 | d-alanyl-d-alanine carboxypeptidase | |
| 59, 60 | 1646 | Dipeptidase (EC 3.4.13.18) | 4690 |
| 61, 62 | 1658 | Prolyl aminopeptidase (EC 3.4.11.5) | 0596 |
| 63, 64 | 1763 | Oligopeptidase (EC 3.4.24.15) | 1164 |
| 65, 66 | 1837 | Dipeptidase (EC 3.4.13.18) | 4690 |
| 67, 68 | 1849 | Aminopeptidase N (EC 3.4.11.2) | 0308 |
| 69, 70 | 1909 | Signal peptidase I | 0681 |
| 71, 72 | 1957 | Prolyl aminopeptidase (EC 3.4.11.5) | 0596 |
| 73, 74 | 87 | Metal-dependent membrane protease | 1266 |
| 75, 76 | 553 | Metal-dependent membrane protease (PlnI) | 1266 |

TABLE 3-continued

Proteases/Peptidases of the Present Invention

| SEQ ID NO: | ORF NO. | FUNCTION | COG |
|---|---|---|---|
| 77, 78 | 601 | Serine protease | 4667 |
| 79, 80 | 604 | Metal-dependent membrane protease (PlnI) | 1266 |
| 81, 82 | 638 | ATPase (ClpE) | 0542 |
| 83, 84 | 660 | Zn-dependent peptidase | 0612 |
| 85, 86 | 661 | Zn-dependent peptidase | 0612 |
| 87, 88 | 1808 | Metal-dependent membrane protease | 1266 |
| 89, 90 | 1810 | Metal-dependent membrane protease | 1266 |
| 91, 92 | 1937 | Metal-dependent membrane protease | 1266 |
| 93, 94 | 1235 | S-layer protein | |
| 95, 96 | 1378 | Biofilm-associated surface protein | |
| 97, 98 | 35 | Dipeptidase (EC 3.4.13.18) | 4690 |
| 99, 100 | 96 | HtpX (EC:3.4.24.-) | 0501 |
| 101, 102 | 569 | Endo-1,4-beta-glucanase, aminopeptidase (EC3.4.11.-) | 1363 |
| 103, 104 | 853 | Metal-dependent amidase/aminoacylase/carboxypeptidase | 1473 |
| 105, 106 | 1661 | Peptidase | 3212 |
| 107, 108 | 1662 | Peptidase | 3212 |
| 109, 110 | 1667 | Peptidase | 3212 |
| 111, 112 | 1588 | PrtM | 0760 |
| 113, 114 | 195 | Aminopeptidase G | 3579 |
| 115, 116 | 165 | Neutral endopeptidase (EC 3.4.-.-) | 3590 |
| 117, 118 | 204 | Aminopeptidase E | 3579 |
| 119, 120 | 1294 | Dipeptidase (EC 3.4.13.18) | 4690 |
| 121, 122 | 1343 | Aryldialkylphosphatase (PepQ) | 1228 |
| 123, 124 | 1567 | Aminopeptidase | 0308 |
| 125, 126 | 1837 | Dipeptidase (EC 3.4.13.18) | 4690 |
| 127, 128 | 1957 | Prolyl aminopeptidase (EC 3.4.11.5) | 0596 |
| 129, 130 | 553 | Metal-dependent membrane protease (PlnI) | 1266 |
| 131, 132 | 601 | Serine protease | 4667 |
| 133, 134 | 660 | Zn-dependent peptidase | 0612 |
| 146, 147 | 1182 | Signal peptidase I | 0681 |

TABLE 4

PFAM Results for Amino Acid Sequences

| SEQ ID NO: | ORF | Domain | Amino Acid Range Start, Stop | Family | PFAM Accession No. |
|---|---|---|---|---|---|
| 2 | 92 | Abhydrolase_1 | 55, 287 | alpha/beta hydrolase fold | PF00561 |
| 116 | 165 | Peptidase_M13_N | 22, 401 | Peptidase family M13 | PF05649 |
| 116 | 165 | Peptidase_M13 | 458, 647 | Peptidase family M13 | PF01431 |
| 6 | 186 | Peptidase_C15 | 1, 200 | Pyroglutamyl peptidase | PF01470 |
| 114 | 195 | Pept_C1-like | 4, 437 | Peptidase C1-like family | PF03051 |
| 118 | 204 | Pept_C1-like | 4, 438 | Peptidase C1-like family | PF03051 |
| 13 | 235 | Peptidase_U34 | 1, 128 | Peptidase family U34 | PF03577 |
| 15 | 236 | Peptidase_U34 | 5, 280 | Peptidase family U34 | PF03577 |
| 17 | 286 | DiS_P_DiS | 11, 94 | Bacterial Peptidase A24 N-terminal domain | PF06750 |
| 19 | 343 | Pept_C1-like | 4, 443 | Peptidase C1-like family | PF03051 |
| 21 | 388 | Peptidase_M22 | 24, 110 | Glycoprotease family | PF00814 |
| 23 | 390 | Peptidase_M22 | 46, 134 | Glycoprotease family | PF00814 |
| 25 | 430 | Peptidase_M24 | 293, 355 | metallopeptidase family M24 | PF00557 |
| 27 | 623 | Peptidase_M24 | 165, 255 | metallopeptidase family M24 | PF00557 |
| 29 | 911 | Pept_C1-like | 3, 437 | Peptidase C1-like family | PF03051 |
| 31 | 994 | Peptidase_M20 | 20, 465 | Peptidase family M20/M25/M40 | PF01546 |
| 33 | 1152 | Peptidase_A8 | 16, 165 | Signal peptidase (SPase) II | PF01252 |
| 37 | 1190 | Peptidase_M20 | 10, 410 | Peptidase family M20/M25/M40 | PF01546 |
| 39 | 1275 | Peptidase_M13_N | 22, 401 | Peptidase family M13 | PF05649 |
| 39 | 1275 | Peptidase_M13 | 455, 644 | Peptidase family M13 | PF01431 |
| 41 | 1280 | LexA_DNA_bind | 3, 67 | LexA DNA binding domain | PF01726 |
| 41 | 1280 | Peptidase_S24 | 124, 193 | Peptidase S24-like | PF00717 |
| 120 | 1294 | Peptidase_U34 | 6, 405 | Peptidase family U34 | PF03577 |
| 45 | 1336 | Peptidase_M24 | 296, 359 | metallopeptidase family M24 | PF00557 |
| 122 | 1343 | Amidohydro_1 | 1, 168 | Amidohydrolase family | PF01979 |
| 50 | 1373 | Peptidase_S15 | 200, 789 | X-Pro dipeptidyl-peptidase (S15 family) | PF02129 |
| 52 | 1512 | Peptidase_S8 | 192, 531 | Subtilase family | PF00082 |
| 52 | 1512 | DUF1034 | 565, 678 | Domain of Unknown Function (DUF1034) | PF06280 |
| 54 | 1515 | Peptidase_M20 | 13, 412 | Peptidase family M20/M25/M40 | PF01546 |
| 58 | 1603 | Peptidase_S11 | 27, 296 | D-alanyl-D-alanine carboxypeptidase | PF00768 |
| 60 | 1646 | Peptidase_U34 | 5, 407 | Peptidase family U34 | PF03577 |
| 62 | 1658 | Abhydrolase_1 | 56, 291 | alpha/beta hydrolase fold | PF00561 |
| 64 | 1763 | Peptidase_M3 | 202, 584 | Peptidase family M3 | PF01432 |
| 126 | 1837 | Peptidase_U34 | 10, 401 | Peptidase family U34 | PF03577 |
| 68 | 1849 | Peptidase_M1 | 6, 379 | Peptidase family M1 | PF01433 |
| 70 | 1909 | Peptidase_S24 | 41, 107 | Peptidase S24-like | PF00717 |
| 128 | 1957 | Abhydrolase_1 | 53, 286 | alpha/beta hydrolase fold | PF00561 |

TABLE 4-continued

PFAM Results for Amino Acid Sequences

| SEQ ID NO: | ORF | Domain | Amino Acid Range Start, Stop | Family | PFAM Accession No. |
|---|---|---|---|---|---|
| 130 | 553 | Abi | 106, 212 | CAAX amino terminal protease family | PF02517 |
| 132 | 601 | Patatin | 5, 172 | Patatin-like phospholipase | PF01734 |
| 82 | 638 | AAA | 139, 331; 467, 682 | ATPase family associated with various cellular activities (AAA) | PF00004 |
| 134 | 660 | Peptidase_M16_C | 170, 344 | Peptidase M16 inactive domain | PF05193 |
| 86 | 661 | Peptidase_M16 | 19, 158 | Insulinase (Peptidase family M16) | PF00675 |
| 92 | 1937 | Abi | 124, 217 | CAAX amino terminal protease family | PF02517 |
| 96 | 1378 | YSIRK_signal | 13, 39 | YSIRK type signal peptide | PF04650 |
| 98 | 35 | Peptidase_U34 | 2, 404 | Peptidase family U34 | PF03577 |
| 100 | 96 | Peptidase_M48 | 85, 298 | Peptidase family M48 | PF01435 |
| 102 | 569 | Peptidase_M42 | 47, 341 | M42 glutamyl aminopeptidase | PF05343 |
| 104 | 853 | Peptidase_M20 | 6, 381 | Peptidase family M20/M25/M40 | PF01546 |
| 106 | 1661 | PepSY | 119, 178 | Peptidase propeptide and YPEB domain | PF03413 |
| 108 | 1662 | PepSY | 62, 121; 141, 199 | Peptidase propeptide and YPEB domain | PF03413 |
| 110 | 1667 | PepSY | 59, 118; 137, 193 | Peptidase propeptide and YPEB domain | PF03413 |
| 56 | 1567 | Peptidase_M1 | 31, 416 | Peptidase family M1 | PF01433 |
| 74 | 87 | Abi | 327, 433 | CAAX amino terminal protease family | PF02517 |
| 80 | 604 | Abi | 255, 343 | CAAX amino terminal protease family | PF02517 |
| 4 | 165 | Peptidase_M13 | 466, 655 | Peptidase family M13 | PF01431 |
| 8 | 194 | Pept_C1-like | 13, 118 | Peptidase C1-like family | PF03051 |
| 9 | 195 | Pept_C1-like | 1, 306 | Peptidase C1-like family | PF03051 |
| 11 | 204 | Pept_C1-like | 11, 445 | Peptidase C1-like family | PF03051 |
| 72 | 1957 | Abhydrolase_1 | 55, 290 | Alpha/beta hydrolase fold | PF00561 |
| 76 | 553 | Abi | 118, 224 | CAAX amino terminal protease family | PF02517 |
| 78 | 601 | Patatin | 9, 176 | Patatin-like phospholipase | PF01734 |

SEQUENCE LISTING (154 sequences)

SEQ ID NO: 1 - DNA, 879 bp, Lactobacillus acidophilus
  CDS (1)..(879): Prolyl aminopeptidase (EC3.4.11.5) ORF# 92
atggaaatcattgaaggaaaaatgccttttatgggctatgaaactcactatcgtattgttggtagaagaagcgaaaaatcgccactagttttgcttcatggtggccctggctcaactcataattattttgaagtgttggacaaattagccaaaatcgatgatcgccgcattattatgtatgaccaattaggttgcggcaatagtagcatccccgacgatcatcctgaactttacacaaaagaaacttgggtgaaagaattaaaaacactacgtgaacatctagctttgcgtaaaattcatttgttaggtcaaagctggggcgggatgctcgctatcatttatatgtgtgattatcacccagagggcattcaaagtttgattttatcaagtaccctttcatcagcttcactatggtcaaaagaattgcaccgcatgatcaagtacttaccaattgaagaacaagctgcaattcatcgtgctgaattaacggacacatttacggagcctgactatttgaaggctaacgaacactttatgaatcaacatgcaattgatatgaagaagaaatggccagaatgcgtcatgcgtgagaaaaaaggtggcacagttgcttacgaaactgcctgggggcctaacgaatatacgcctgaaggtaatttacatgattatgaatacactgatcaattgagtaaaataaaagttccaactctgattacgagtggaaccgatgatttgtgtactccatatgttgctaagacaatgcatgatcatattgcgggcagtcaatggaaactattcgaaaattgtagtcatatgtccttcgtgcaaaaaactgacgaatatattgctatgcttaagaaatggcttgatgccaatgac

SEQ ID NO: 2 - protein, 293 aa, Lactobacillus acidophilus
MEIIEGKMPFMGYETHYRIVGRRSEKSPLVLLHGGPGSTHNYFEVLDKLAKIDDRRIIMYDQLGCGNSSIPDDHPELYTKETWVKELKTLREHLALRKIHLLGQSWGGMLAIIYMCDYHPEGIQSLILSSTLSSASLWSKELHRMIKYLPIEEQAAIHRAELTDTFTEPDYLKANEHFMNQHAIDMKKKWPECVMREKKGGTVAYETAWGPNEYTPEGNLHDYEYTDQLSKIKVPTLITSGTDDLCTPYVAKTMHDHIAGSQWKLFENCSHMSFVQKTDEYIAMLKKWLDAND

SEQ ID NO: 3 - DNA, 1974 bp, Lactobacillus acidophilus
  CDS (1)..(1974): pepO neutral endopeptidase (EC 3.4.-.-) ORF# 165
ttgaataaagggggattttccttaatgagtaataaagtgactgttcgtggtggtgctggtaatatcctcgaacctaaagttggtactcgtccacaagataatttatatttagctgttaactcagactggcttgagaaggctaagattccttcagatcgttcaagaattgctagttttgatagtattgatcttaacgtagaaaagagcttaatgaaggatttcgcagattttgcggatggcaaaaaagaagtagccgatgtaccgaacttgaagaaggcagttgaactatataagcttgctcgtgactttaagcgtcgtgatgaagatggcgctaagcctattcaagctgatttgttcttacttgaaagtatcagtgactttgctgatttcaacttgaaggctgctgatttatttaaggcttcattttcattgccatttggtttagatattgatgctgatatgaagaatactaagattaatgttcttcaatttattggaccatcaacattcttgccagatactactacttacaagacagaagctgctggaaagcttttggaagttttgaagaagcaatcaattaacttgcttaagatggctggcgtttctgaaggtcaagctaaggaatacgtggaagatgccttaaaatttgataaaaagctttctgaagtagttaaatcatcagaagaatgggcagattatccagcaatgtataatccaacttcaatggaagattttgaaggcaagattaagaacttcaagattgattacttcttgaaggaagctttaggtgaagttcctgatagaattattgttactgaaccacgtttcttgaaacactttgatgaattaatgaatgaagaaaactttgatgaaattaagggttggatgatcgttaagtttattaataatgttgcaagttacttgtcacaagatttccgtgaagcatcattccaatttagtcaagcattgacaggccaaccggaattacaaagccaagaaaagcaagcatatcatttagctaatggtctattcagcgaagtagtcggtgtttactatggtcaaacatactttggtgaagaagctaaaaaagatgttttaactatgattcgccaaatgattgatgtttacgaaaagcgtattaaggaaaattcatggctttctgaagaaactaaggaaaaggctattgttaagcttcgtgcattgatcttaaagattggttaccctgataagattgaagaaatctataatcgctacaatataactcctgctagtgaaggcggtagtctttactcaaacgtaagagcagctgatattgaacaagttaaatataacgttgaaaagttacataaaccagttgatcgtagcgtatggctcatgccagccaacttggtaaatgcttgctatgatccacaaagaaatgacttaactttcccagcagcaattttgcaagcaccattttatgacttaaagcaagatcgtgctgaaaactttggtggaattggtactgttattgctcatgaaatttctcatgcctttgataacaatggtgcacaattcgatgaattcggtaatatgaagaattggtggactgaagaagacttcgctgaatttaagaagcgtactcaagcagaaatcgacttgttcgatggtattaaatacggccctgttactttgaacggtaagcaaatcgtttcagaaaatattgccgaccaaggtggtcttactgcagctattaaggcagctaaggacgaaggcgatgatttgaagaaattgtttgaaaactttgctcgtatttgggctaacaagcaacttactgaatctattaagacacaagtttcttttgatgttcacgcaccaggtccagaacgtgcaaatgttcaatcacaatgtcaagaagacttctatgaagtatttgatgttaaggaaactgatggtatgtggttagatccagaaaaacgtgtagttatttgg

SEQ ID NO: 4 - protein, 658 aa, Lactobacillus acidophilus
LNKGGFSLMSNKVTVRGGAGNILEPKVGTRPQDNLYLAVNSDWLEKAKIPSDRSRIASFDSIDLNVEKSLMKDFADFADGKKEVADVPNLKKAVELYKLARDFKRRDEDGAKPIQADLFLLESISDFADFNLKAADLFKASFSLPFGLDIDADMKNTKINVLQFIGPSTFLPDTTTYKTEAAGKLLEVLKKQSINLLKMAGVSEGQAKEYVEDALKFDKKLSEVVKSSEEWADYPAMYNPTSMEDFEGKIKNFKIDYFLKEALGEVPDRIIVTEPRFLKHFDELMNEENFDEIKGWMIVKFINNVASYLSQDFREASFQFSQALTGQPELQSQEKQAYHLANGLFSEVVGVYYGQTYFGEEAKKDVLTMIRQMIDVYEKRIKENSWLSEETKEKAIVKLRALILKIGYPDKIEEIYNRYNITPASEGGSLYSNVRAADIEQVKYNVEKLHKPVDRSVWLMPANLVNACYDPQRNDLTFPAAILQAPFYDLKQDRAENFGGIGTVIAHEISHAFDNNGAQFDEFGNMKNWWTEEDFAEFKKRTQAEIDLFDGIKYGPVTLNGKQIVSENIADQGGLTAAIKAAKDEGDDLKKLFENFARIWANKQLTESIKTQVSFDVHAPGPERANVQSQCQEDFYEVFDVKETDGMWLDPEKRVVIW

SEQ ID NO: 5 - DNA, 600 bp, Lactobacillus acidophilus
  CDS (1)..(600): Pyrrolidone carboxylpeptidase (EC 3.4.19.3) ORF# 186
atgaaaatcttaataactggatttgatccttttggtggggaaaaaattaatcctgcaattgaagctgtaaaaaagttacctgacgaaatagatggtcatcaaattattaaattagaggtgccgactattttttatgaaagtgccagagtagtcaaaaatgcaatagaaaaatatcagccagatatggttattaacgtggggcaagcgggaggccgtgcagcaattactccagaacgaatcgctattaattttcaatctggttcaactcctgataattcgggtaaaggaccaaaagaaggcaaaattgaagcagatggtgctgatggttatttcactcagttgccaatcaaaaaaatggtgacagccacaagaaaagcgggggttcctagtgaaatttccaattctgcaggtaattatgtgtgcaatcatcttttttatgaattacaatacatgcgagttcatgaatttcctaatttgaaaacgggatttattcatattccatttttgccaagccaggttaaaaatggacggcatccttcgatgagtttatcctatatggttaaagggttaaccgcttccattaaggcggcagtagacgcc

SEQ ID NO: 6 - protein, 200 aa, Lactobacillus acidophilus
MKILITGFDPFGGEKINPAIEAVKKLPDEIDGHQIIKLEVPTIFYESARVVKNAIEKYQPDMVINVGQAGGRAAITPERIAINFQSGSTPDNSGKGPKEGKIEADGADGYFTQLPIKKMVTATRKAGVPSEISNSAGNYVCNHLFYELQYMRVHEFPNLKTGFIHIPFLPSQVKNGRHPSMSLSYMVKGLTASIKAAVDA

SEQ ID NO: 7 - DNA, 1337 bp, Lactobacillus acidophilus
  CDS (1)..(372): Aminopeptidase G ORF# 194
  CDS (420)..(1337): Aminopeptidase G ORF# 195
atgatttttgacgagaaaggaaaatcaatgaaacacaagctgacaatggcagaaattgccaaatttcaacaagaatatgagaagcaacctagaaatcgtgttgctgaacttgcagtagtgaataatggtgtacaaaaggccagctttaataatgagggggttagaaagctaaatcgtacattttctattgaaattcccacagataatgtaactgatcaaaaacaatcgggtcgctgctggttatttgcagcattgaatacgcttcgccatggctttgctaaaaagcaaaatgctaagaattttactttttcacaaaattatctattcttctgggatagagtagaaagagccaattcttctttgataatattttaaatactgcggataagccactggatgacagaacggttcatacctatatgcaaggtcctgatactgatggtggtcaatgggctatggctgtttctttaattagaaagtatggtttagttccaacatatgcacaagatgaaagctttactgctaacaatacagctgcgtttaatagcgccttaaatatgaaactgcgtgaagatggtttagtattgcgtaaactttatcaagaaaagaaaatggatgaaatcgaaactaaacgtcaagaatttttgagtgaagtttatagaatggctgttattgcatttggtgaaccagttcaaaaatttgatcttgaatttaaagatgataatggcaattatcattttgatgggaatttaactccattagacttcttccacaattatttcactgatgatctagatgattacattgttttgtttaatgcacctgatcatgaatttgataagctttatgctcttccatttgaagataatgttgaaggcggcacaccagtacaatttttgaatacagaaattgataatttaaaagaagcggctattaagcagcttgaagctggtgaaactatttggtttggttgtgatgttggtaaagagagtgatcgtcaaaaaggtatcttgtctaagggtctttaccaaacagatttaatttttgatattgaaactaagttaaataaaaaagaaagattacaaactggtgcttcaggctcaacgcatgccatgactttagtgggagttgacgttgtagacggacagcctcaacaatggaaggttgaaaattcatggggcagtaaggtcggtgaaaagggctactttgtcatgaatgatgagtggtttaatgaatacttattcaaggtggttgtaaaaaagcaatatgtaccagaaaaattaattaagatctgggaaggcgaagcaacaccagtagaagcatgggactcaatggca

SEQ ID NO: 8 - protein, 124 aa, Lactobacillus acidophilus
MIFDEKGKSMKHKLTMAEIAKFQQEYEKQPRNRVAELAVVNNGVQKASFNNEGVRKLNRTFSIEIPTDNVTDQKQSGRCWLFAALNTLRHGFAKKQNAKNFTFSQNYLFFWDRVERANSSLIIF

SEQ ID NO: 9 - protein, 306 aa, Lactobacillus acidophilus
MQGPDTDGGQWAMAVSLIRKYGLVPTYAQDESFTANNTAAFNSALNMKLREDGLVLRKLYQEKKMDEIETKRQEFLSEVYRMAVIAFGEPVQKFDLEFKDDNGNYHFDGNLTPLDFFHNYFTDDLDDYIVLFNAPDHEFDKLYALPFEDNVEGGTPVQFLNTEIDNLKEAAIKQLEAGETIWFGCDVGKESDRQKGILSKGLYQTDLIFDIETKLNKKERLQTGASGSTHAMTLVGVDVVDGQPQQWKVENSWGSKVGEKGYFVMNDEWFNEYLFKVVVKKQYVPEKLIKIWEGEATPVEAWDSMA

SEQ ID NO: 10 - DNA, 1335 bp, Lactobacillus acidophilus
  CDS (1)..(1335): pepE Aminopeptidase E ORF# 204
atgagaaaaggagattttttaatggctcatgaactcactgtgcaagaactagaaaagttctctgctgattttaacaagaatccaaagaataaaattattgctcgtgcggctcaacgtagcggtgtgctcgaagcatcttacaacgatcgcgtagaaggtgaattaactcgcgttttttcaacggaattagatactgacaacgttactaaccaacttcactcaggtcgttgctgggagttttcaaccttaaatgttttgcgtcatgcatttggcaagaagtacaaagcaaagaactttaccttctcacaagcctacaacttcttctgggataagattgaacgtgctaatatgttctacaatcgtatcttagatagtgctgacatgcctcttgattctcgtcaagtgaaagctgatctcgactttgctggtgcagacggtggacaattccaaatggctgccgcattagtagaaaaatatggcgttgttccttcatacgcaatgcctgaaactttcaacactaataatacaactagctttgcgacagctcttggtgacaagcttaaaaaagacgcattagttcttcgtgaattaaagcaatatggtaaagatgacgaaatcgctaagactcgtgaaaaattcttgagtgaagtttaccaaatgactgctatcgctgtcggtgaaccacctaagacgtttgatcttgaatatcgtgatgatgataagaaatatcatttagacaagaatcttacaccacttgaattcttacataagtatatgggtgaggttgattttgatgactatgttgttttaactaatgcacctgatcatgaatacaacaagttatacggtcttccagcagaagataacattgaaggctcacttagaatcaagcttttaaatgtacctatggaatacttatcatcagctgctattgctcaattaaaagatggtgaagcagtatggtttggtaacgatgttcttcgtcaaatggaccgcaagactggttatcttgatactaacctttacaaacttgacgatttattcggcgttgatcttaagatgtctaaagctgacagattaaggactggtgttggtgaagtttcacacgcaatgaccttggttggtgttgatgaagataatggcgaaatccgtcaatggaaggtcgaaaactcatggggcgaaaaatctggttctaaaggattctttgttatgagtaatgactggttcaacgactatgtatatgaagttgttgttcacaagaagtatttaaccgataagcaaaaagaacttgcagaaggtcctattaccgacttgcctgcatgggattcattagct

SEQ ID NO: 11 - protein, 445 aa, Lactobacillus acidophilus
MRKGDFLMAHELTVQELEKFSADFNKNPKNKIIARAAQRSGVLEASYNDRVEGELTRVFSTELDTDNVTNQLHSGRCWEFSTLNVLRHAFGKKYKAKNFTFSQAYNFFWDKIERANMFYNRILDSADMPLDSRQVKADLDFAGADGGQFQMAAALVEKYGVVPSYAMPETFNTNNTTSFATALGDKLKKDALVLRELKQYGKDDEIAKTREKFLSEVYQMTAIAVGEPPKTFDLEYRDDDKKYHLDKNLTPLEFLHKYMGEVDFDDYVVLTNAPDHEYNKLYGLPAEDNIEGSLRIKLLNVPMEYLSSAAIAQLKDGEAVWFGNDVLRQMDRKTGYLDTNLYKLDDLFGVDLKMSKADRLRTGVGEVSHAMTLVGVDEDNGEIRQWKVENSWGEKSGSKGFFVMSNDWFNDYVYEVVVHKKYLTDKQKELAEGPITDLPAWDSLA

SEQ ID NO: 12 - DNA, 582 bp, Lactobacillus acidophilus
  CDS (1)..(582): Dipeptidase (EC 3.4.13.18) ORF# 235
ttgatctcaatcgaagatattaagtgggccgaaagttcacactaccaagacactccatacgatgcttatggcgaccaaggtactccggaacaaaagaagaccttccgtccaattggtattaaccgtaacttcgaaactcacattttacaaattagaaacgacgtccctgcagaaatcgctggtgttcaatggttggcatttggccctaataccttcaactcaatggtgccattctatactaatgtaactactacaccagaaagcttccaaactactcctaagttcaacttgaacaagatcttctggcttaataagttaactgcccaacttggtgacaccaattaccgcgtatacggagaacttgaagatgcttttgaacaaaagagtttggcacaatgccacaagatccaacacgacactgacaaagaagttaagggtctttcaggtaaggaattacaagataagttaaacgcagctaaccagttgatggccgacactgtttacaacaataccgttgaacttcttggtcaaatggttgacgaaggtcacggtttgatgactttgaagtacgacttgcttgat

SEQ ID NO: 13 - protein, 194 aa, Lactobacillus acidophilus
LISIEDIKWAESSHYQDTPYDAYGDQGTPEQKKTFRPIGINRNFETHILQIRNDVPAEIAGVQWLAFGPNTFNSMVPFYTNVTTTPESFQTTPKFNLNKIFWLNKLTAQLGDTNYRVYGELEDAFEQKSLAQCHKIQHDTDKEVKGLSGKELQDKLNAANQLMADTVYNNTVELLGQMVDEGHGLMTLKYDLLD

SEQ ID NO: 14 - DNA, 840 bp, Lactobacillus acidophilus
  CDS (1)..(840): Dipeptidase (EC 3.4.13.18) ORF# 236
atgaaacaaacagaatgtactactatcttagtaggtaaaaaagcaactatcgacggttcaaccatgatcgcacgtagtgaagacggtggtcgtgtaattatccctgaagggttcaaagtagttaaccctgaagaacaacctaagcactacactagcgctatcagtaagcaaaagattgatgatacagacttagctgaaactccacttcgttacacctcagcacctgatgtatctggtgaaaatggtatttggggagcagctggtattaattctgaaaatatcgccatgactgctactgaaactattactactaattcacgtattcaaggtgttgacccactccttgacccagctgaaggtggtcttggtgaagaagatttcgttacactaacgcttccatacattcactcagcttttgatggtgttaagcgcgtaggttacctagttgaaaaatacggtacttacgaaatgaacggcatggctttttcagataaagatactatttggtaccttgaaactatcggtggtcaccactggattgcacgtcgcatccctgacgatgcatatgttattgctccaaaccgtttgaacatcgatgaattcgacttcgatgataccgacaattttgctgcagctagtgacttgaaagacttaatcagtgaatatcacttgaacccagaccgtgaaggctacaacatgcgccacatctttggttcatcaactatcaaggacgctcactacaacaatccacgtgctggtacattcacaactacttcgatccagacttcggcggcactcccgctgatcaagatcaaccattcatttgccacgcaaatcgtt

SEQ ID NO: 15 - protein, 280 aa, Lactobacillus acidophilus
MKQTECTTILVGKKATIDGSTMIARSEDGGRVIIPEGFKVVNPEEQPKHYTSAISKQKIDDTDLAETPLRYTSAPDVSGENGIWGAAGINSENIAMTATETITTNSRIQGVDPLLDPAEGGLGEEDFVTLTLPYIHSAFDGVKRVGYLVEKYGTYEMNGMAFSDKDTIWYLETIGGHHWIARRIPDDAYVIAPNRLNIDEFDFDDTDNFAAASDLKDLISEYHLNPDREGYNMRHIFGSSTIKDAHYNNPRAGTFTTTSIQTSAALPLIKINHSFATQIV

SEQ ID NO: 16 - DNA, 687 bp, Lactobacillus acidophilus
  CDS (1)..(687): Prepilin peptidase (EC 3.4.99.-) ORF# 286
ttgaactcaatatattttttacttaattttttcataggagcatgcttagcttcacatgcaaacgttatatacgaacgatgggatactcgtaactttatcttttctcggtcttattgtgataattgtaaaagtactctttcactattggacgaaattcctctattctcttatttacttttgaaaggcaaatgtaagtattgccaaaaaaatattccgcgtgaattattcttttttgaactagttggtggctttgctttttgtacaataaattttagtgataaaagtcaaattatcacttctatctttattttttctcttcttttaattgcaatctctgattattatcaaaatgaatttgatttaatttttatttttccagcaattattacttctattttatttaatcgcatttacttatttaactggattgaatggctatcttttctaccagttttgatagtccttagtatttattcatttaaacaaaaaatgggattaggtgatttattaatctatgtcctaatctccacttattttactcccacttttgcaaacttaactttactttttgctgctttaattttaataatcattcattttacagaaaataatttagcttcatataattatccatttattccattcatttttattggactaattatttcaaaatttatttttgaacaa

SEQ ID NO: 17 - protein, 229 aa, Lactobacillus acidophilus
LNSIYFLLNFFIGACLASHANVIYERWDTRNFIFSRSYCDNCKSTLSLLDEIPLFSYLLLKGKCKYCQKNIPRELFFFELVGGFAFCTINFSDKSQIITSIFIFSLLLIAISDYYQNEFDLIFIFPAIITSILFNRIYLFNWIEWLSFLPVLIVLSIYSFKQKMGLGDLLIYVLISTYFTPTFANLTLLFAALILIIIHFTENNLASYNYPFIPFIFIGLIISKFIFEQ

SEQ ID NO: 18 - DNA, 1347 bp, Lactobacillus acidophilus
  CDS (1)..(1347): Aminopeptidase C ORF# 343
atgtcaaaagaaatttctaaggatactattaataaatttgaacaagatttaactaatcacccagcttataaagttgccagccgtgcagcacaagaaaatggcatttttaaagcaagtcaagatttacaaactaaaattgatcttgatccaactttttcaattgaaattgaaactggtaaaccagctgaccaaaagcaatccggtcgttgctggatgttcagcgcattaaataccatgcgtcacccacttcaaaagaaattccaattgaaggacttcgaattatctcaaaattacaccaacttctgggataaatttgaaaagtcaaactggttctttgaaaatgttattgcaactgcagataagccactcggcgatcgcaaagtttcattcttgtttgccactccacaacaagacggtggtcaatgggatatgctttgtggcattattgaaaaatacggtatcgtaccaaagagtgtttacccagaaactgctaatgcaactaactcaagtgcattaaacgacactttaaacaccttgcttcgtaaagatggtctagaattacgtaaattggttaacgatggtaagtcagaagaagaaattcaaactcgtaaggaagaaatgcttaacgatgtcttccgcgtactagctgtttcacttggcgttccaccaaagaaatttaacttcgaatatcgtgacgatgacaagaattaccatattgataaggacattactccaaaggaattctttgataaatatgttggtatggaccttgaagaccacatctcaactatcaatgctccaactagtgacaagccattccataaagtattctcagttgaatacttaggtaatgttgaaggtggtcgtcaagttcgtcacttgaacttaaaggttgatgaaatgaaagacttaatcatcaagcaactaaagagcggcgaagttgtatggtttggttcaaacgttgttaaggactcagaaagaagagctggtcttcttgatactgacctttacagacgtgacgaattatttgacgtggacttttcaatgtcaaaggctgaaaagcttgattctggtgaaagtatgatggaccatgctatggttatcactggtgttgatattgttgatggcaaaccaactaagtggaagatcgaaaactcatggggcgaaaagcctggcttcaaaggttactttgtaatgagcgacaaatggtttgattcatttgtttaccaagctgttatcaacaagaaattcttgccagacgacttaaagaaagcctacgatgaaggtgttaaagatccaatccaattattaccatgggatccaatgggtgctttagcatttgatttt

SEQ ID NO: 19 - protein, 449 aa, Lactobacillus acidophilus
MSKEISKDTINKFEQDLTNHPAYKVASRAAQENGIFKASQDLQTKIDLDPTFSIEIETGKPADQKQSGRCWMFSALNTMRHPLQKKFQLKDFELSQNYTNFWDKFEKSNWFFENVIATADKPLGDRKVSFLFATPQQDGGQWDMLCGIIEKYGIVPKSVYPETANATNSSALNDTLNTLLRKDGLELRKLVNDGKSEEEIQTRKEEMLNDVFRVLAVSLGVPPKKFNFEYRDDDKNYHIDKDITPKEFFDKYVGMDLEDHISTINAPTSDKPFHKVFSVEYLGNVEGGRQVRHLNLKVDEMKDLIIKQLKSGEVVWFGSNVVKDSERRAGLLDTDLYRRDELFDVDFSMSKAEKLDSGESMMDHAMVITGVDIVDGKPTKWKIENSWGEKPGFKGYFVMSDKWFDSFVYQAVINKKFLPDDLKKAYDEGVKDPIQLLPWDPMGALAFDF

SEQ ID NO: 20 - DNA, 732 bp, Lactobacillus acidophilus
  CDS (1)..(732): Putative glycoprotein endopeptidase ORF#388
atgagaatcttaagcgtttctacggctactaatcatttaagtgttgcattaaatgatagtcaacaaattattgtcgaaaaaaatgaacaagatgaacgtaatcatagtgaacatcttgatccattaattgatgaaattttaaaagaaaatcagttaaccttaaaagatattgatcgttttgcagttgctattggcccaggttcatatactgggcttagaattggaattactactgttaaaatgtttgctagtgttttgaataaagaagtagtaggaatttcaacattacaagcattggctaaatccgttaaggaagatgcattagtaattactggattagatgcaagaaataataattattttgcagcaggctataagagcggtgatattccagataatgtaattcctgatggtcactataatatcgatgtcttaattaaagcaatccaagattatactgctaaaaatgaagttaagaagcttgttttagtgggaactggtttagaaaaacaagatgaaaaatttaaggctttgaatattccatataaatatggtaatgatagtcaaaatgtaatccatgcaggcttaattggacaattagctgaatactcagaaccagttgatccagataagttattgccacgctatctacgtagaactcaagctgaagtagattggcacaagaagacaggaaaaccattcgaaccagatagtcattatgttgaagaagtt

SEQ ID NO: 21 - protein, 244 aa, Lactobacillus acidophilus
MRILSVSTATNHLSVALNDSQQIIVEKNEQDERNHSEHLDPLIDEILKENQLTLKDIDRFAVAIGPGSYTGLRIGITTVKMFASVLNKEVVGISTLQALAKSVKEDALVITGLDARNNNYFAAGYKSGDIPDNVIPDGHYNIDVLIKAIQDYTAKNEVKKLVLVGTGLEKQDEKFKALNIPYKYGNDSQNVIHAGLIGQLAEYSEPVDPDKLLPRYLRRTQAEVDWHKKTGKPFEPDSHYVEEV

SEQ ID NO: 22 - DNA, 1047 bp, Lactobacillus acidophilus
  CDS (1)..(1047): Endopeptidase (E.C. 3.4.24.57) ORF# 390
ttgagtgaaaagaaagacgttcgcattttagcttatgaaagttcatgtgatgaaacttcaactgctgttataaaaaatggacgtgaaattgaaagtttaattgttgcaacccaaattaaaagtcatcaacgttttggtggagttgtacctgaagttgctagtcgacatcacattgaagtagttagccaaattactaaagaagctctaaatgaagcaaattgcagttggaaagatattgacgcaattgctgtaacttatggtccaggccttgtaggtgcccttttgattggagttagcgctgctaaggctgtatctatggcaacaggaattccattgattggtgttgatcatattatgggacatattatggctgctcaattaaaagacgaaattgaatatccagctattgctttgcaagtgtctggtggtcatactgaaattgtcttattaaaggatcctactcattttgaaattattggtgatactcgtgatgatgctgcaggtgaagcatatgacaagattggtcgtgtgcttggtgtaaattatcctgcaggtaagacgattgatgcgtgggcacatcaaggtaaggatacttttaatttcccacgtgcgatgctggaagatgatgattatgatttttcattttcgggtcttaagtcagcttttattaatacttgtcatcatgcagatcaaatccatgaaaagttgaataaatatgacttggctgctagctttcaagctgctgtaatcgatgttcttgctcataagactattagagcaatcaaagagtataaacctaagacatttattatgggtggcggggttgccgcaaatcaaggtttacgtgatcgaatgagtgaagagattgctaagcttcctaaagcagatcaaccaaaagttattttgcctgatcttaaactttgtggtgataatgctgctatgattggtgcagctgcttataatctttataatggtgggcaatttgctgatctgactttaaatgcagatccatcattagaattgccatatgctaaaagtatgttgaat

SEQ ID NO: 23 - protein, 349 aa, Lactobacillus acidophilus
LSEKKDVRILAYESSCDETSTAVIKNGREIESLIVATQIKSHQRFGGVVPEVASRHHIEVVSQITKEALNEANCSWKDIDAIAVTYGPGLVGALLIGVSAAKAVSMATGIPLIGVDHIMGHIMAAQLKDEIEYPAIALQVSGGHTEIVLLKDPTHFEIIGDTRDDAAGEAYDKIGRVLGVNYPAGKTIDAWAHQGKDTFNFPRAMLEDDDYDFSFSGLKSAFINTCHHADQIHEKLNKYDLAASFQAAVIDVLAHKTIRAIKEYKPKTFIMGGGVAANQGLRDRMSEEIAKLPKADQPKVILPDLKLCGDNAAMIGAAAYNLYNGGQFADLTLNADPSLELPYAKSMLN

SEQ ID NO: 24 - DNA, 1104 bp, Lactobacillus acidophilus
  CDS (1)..(1104): Xaa-Pro dipeptidase (EC 3.4.13.9) ORF# 430
atgaacttagataaactacaacagtggttgcaagattccaataatgatattgcatatatctccaatccaattacaatttcatactttactggatattcaatggaaccacatgaaagaatttttgctttaattgcgtttaaagatgcagaaccttttatcttctgccctgctttaaatgtagaagaagctaaagcttcagaatggaatggtgacgttgttgggtatctcgactcagaagacccttggcaaataatcgcagataacatcagaaagagaaccagcgatattcataactgggcaattgagaaagatgatttatctgtaagtcattatcaacttttacgtggcgaatttcctaatgccagtttaaccaacgatgtttcaccttttattgaaagacttcgtcttttcaagacacccgaagaaattaagaaattacaaggtgctggagcagaagctgactttgcctttcaaatcggttttgatgcaatcagaactggcgtaactgaaagaagtatcgctggacaaatagattatcaattaaagattcaaaaaggcgtaatgcacgagagttttgaaactattgttcaagctggtaaaaatgctgctaacccacacttgggaccaactatgaataaaattcaacccaatgaattagtattattcgatttaggtactatgcatgatggttacgcatcagatgcaagtagaactgtagcttatggcacacctagcgacaaacaacgtgaaatttacgaagttgatagagaagctcagcaagcagctattgaagcagcaaaacctggcattactgccgaagaacttgacagtgttgctcgtgatattattactaaagccggttatggcgaatacttcattcaccgtttaggtcacggtatcggtaaaaatgttcacgaatttccatcaattgttcaaggtaatgatttagtaattcaagaaggtatgtgcttctccatcgaaccaggaatttacatccccggctttgcgggagtgcgaattgaagattgtggggttgtaactaaagatggcttcaaaccatttactcacaccgacaaagaacttaaaatcttaccacttaaagat

SEQ ID NO: 25 - protein, 368 aa, Lactobacillus acidophilus
MNLDKLQQWLQDSNNDIAYISNPITISYFTGYSMEPHERIFALIAFKDAEPFIFCPALNVEEAKASEWNGDVVGYLDSEDPWQIIADNIRKRTSDIHNWAIEKDDLSVSHYQLLRGEFPNASLTNDVSPFIERLRLFKTPEEIKKLQGAGAEADFAFQIGFDAIRTGVTERSIAGQIDYQLKIQKGVMHESFETIVQAGKNAANPHLGPTMNKIQPNELVLFDLGTMHDGYASDASRTVAYGTPSDKQREIYEVDREAQQAAIEAAKPGITAEELDSVARDIITKAGYGEYFIHRLGHGIGKNVHEFPSIVQGNDLVIQEGMCFSIEPGIYIPGFAGVRIEDCGVVTKDGFKPFTHTDKELKILPLKD

SEQ ID NO: 26 - DNA, 825 bp, Lactobacillus acidophilus
  CDS (1)..(825): ampM methionine aminopeptidase (EC 3.4.11.18) ORF# 623
ttgattacaattaaatcaattcgtgaacttaaaggtatgcaagcttcaggccatcttcttgcaacaatgtttgaaggcttacgtgatgttatcaaaccaggaatttcaacttgggaaattgaagaattttgtcaagattttgttaaaagtcgtggtggtcgtctttcagaacaaggttttgaaggctacaaatatggtacttgtatttcagttaatgatgaaattgctcaccaaaccccaagaaaagatcgtatcttaaaggagggcgacatcgttaaggttgatgttacttgcaacttgaatggctatgaatcagattcttgtactacttacccagtaggtaaaatttcagaagctgataagaagttgattgaagtaactaagaaggcaatgtatcttggaatcgatcaagctgttttgggtaaccgtattggtgacattggtgctgcaattcaacattatgttgaagtagaaaatcattatggtgacgttcgtgaattaattggtcatggtattcaaccttcaattcacgaagatccggaagttcctcactggggtaaagctggtcatggtcttcgtcttcgtgaaggtatgactattacttgtgaaccaatggtagaagctggtggagactggcatattgatcaaagaacagttgatgatccaaacgatgattgggtatattacgcaactccagatggttcaaatgctgcacagtttgaacatacttttgctattactaaagatggtcctaagattttaactttacaacgtccttatgatggcttagaaaagtacatcccacactttgatgaaatggatgac

SEQ ID NO: 27 - protein, 275 aa, Lactobacillus acidophilus
LITIKSIRELKGMQASGHLLATMFEGLRDVIKPGISTWEIEEFCQDFVKSRGGRLSEQGFEGYKYGTCISVNDEIAHQTPRKDRILKEGDIVKVDVTCNLNGYESDSCTTYPVGKISEADKKLIEVTKKAMYLGIDQAVLGNRIGDIGAAIQHYVEVENHYGDVRELIGHGIQPSIHEDPEVPHWGKAGHGLRLREGMTITCEPMVEAGGDWHIDQRTVDDPNDDWVYYATPDGSNAAQFEHTFAITKDGPKILTLQRPYDGLEKYIPHFDEMDD

SEQ ID NO: 28 - DNA, 1311 bp, Lactobacillus acidophilus
  CDS (1)..(1311): Aminopeptidase ORF# 911
atggcaattatttcagatcaagaaattgcggatttttccgcagattttaattctaatagtgaaaacttagttgcatcttgtgcagctcggcgtaatggattattagaagcttctttcaatgatcgagtttcagaaaaattaaatcatgttttttcaactgaacttgatattggtggtgtaactaatcaaaaacaatctgggcgttgttgggagtttgccacattaaatgttttacgacattattttggtaagaaaaataatgtgaaagatttcactttttctcaagcatataatttcttttgggataaaattgaacgggcaaatgcattttatgatgcaatgattcgcttagccgataaaccgattaatgatcgtgaagttcaatcatggttatcttttgcaggtgaagatggcggattatggagtatggcaattaatttggttaaaaaatatggggtagtaccatcatatgcaatgccagaaagttttaattctaatcatacagctggattgattgattcacttgctcgtaaagaaagaaaagatgcaattcttttacgtaaattagtgaatgaaaataggcaaaatgagattgcagaaactaagaaaaaggctttaaatgaagtttatcgaatggtttctgtagcattaggagaaccacctaaaaagtttgatttagaatatcgtgatgatgataaaaaatatcatttggaaaaagacttaactccacgtgcttttgttcaaaagtattttaaagactttaaatttgacgattatgtagtgttatctaattgtccaaatcatgagtttaacaaattgtatcatatgccgctttatgacaatgtggatggtggtgatcagattaagtttttaaatgtaccaattgaatatctttctcaagccgctgtagctcagcttaaatcaggggatgccgtaatttttggcaatgatgtttccaaacaaatggagcgaaaaactggatatttagatacaaatctttatgaaacagataaattatttggtgtagatactaaaatgagtaaagcagatcgcttggcaacgggagaaggatttgctacacatgatatgactttagttggtgttgatgaagataatggtcatattcgcaagtggaaagtagaaaattcttggggtgataaatttggtcataatggattctatgaaatgagtcaacaatggtttgaagattatgtctatgacgtagtagtcagaaaagaatttttaactgacgaacaattaaaattggcagaaggtcctgcaattgatcttaaaccatgggataacattggc

SEQ ID NO: 29 - protein, 437 aa, Lactobacillus acidophilus
MAIISDQEIADFSADFNSNSENLVASCAARRNGLLEASFNDRVSEKLNHVFSTELDIGGVTNQKQSGRCWEFATLNVLRHYFGKKNNVKDFTFSQAYNFFWDKIERANAFYDAMIRLADKPINDREVQSWLSFAGEDGGLWSMAINLVKKYGVVPSYAMPESFNSNHTAGLIDSLARKERKDAILLRKLVNENRQNEIAETKKKALNEVYRMVSVALGEPPKKFDLEYRDDDKKYHLEKDLTPRAFVQKYFKDFKFDDYVVLSNCPNHEFNKLYHMPLYDNVDGGDQIKFLNVPIEYLSQAAVAQLKSGDAVIFGNDVSKQMERKTGYLDTNLYETDKLFGVDTKMSKADRLATGEGFATHDMTLVGVDEDNGHIRKWKVENSWGDKFGHNGFYEMSQQWFEDYVYDVVVRKEFLTDEQLKLAEGPAIDLKPWDNIG

SEQ ID NO: 30 - DNA, 1401 bp, Lactobacillus acidophilus
  CDS (1)..(1401): pepD aminoacyl-histidine dipeptidase (EC 3.4.13.3) ORF# 994
atgaatttagattataaggaattagctcaagctaaaaaagaagatattcttcgtgatcttggcgaattaattgcaattgactcgtcagaagatttagacaatacatctattgaatatcctgttggtcctggcccagttaaggcaatgaagaagtttttatcatttgctgaacgtgatggtttccacgttaaaaacgttgataactatgctggtcgcgttgattacggtgaaggtgaaaagcgtttaggcgttattgggcatatggatgtagttcctgccggtgatggctgggttacagatccatttaagatgattattaaagatggaaaaatcattggtcgtggttcagctgatgacaaaggacctgctttggcagcttattacggtatgcttttacttaaagaagctggctttaaacctaaaaagaaaattgactttattgtcggtactaatgaagaaactaattgggttggtattaattactacttaaaacatgaaccgactcctgatcaagttttctcacctgatgcggaatatccaattattaatggtgaacaaggcatctacacattagaacttaatttcaaagacgataagccaaaaggctcagtagtcctcaagaaatttaaagccggtattgctacaaatgttacaccacaaaaggcttttgccactattcaagctgacaatcttgacgaaattaaagctaaatttggtgaatttctggcggaaaataatctagagggacattttgaaattgatgataatattgctcagattgaattaactggccaaggtgctcatgcatctgctccacaagttgggcgtaatgctgctacctttttagctttattcttagatcaatttgactttgcaggtcgtgataaaaattatattcacttcttagcagacgttgaacatgaagacttccaaggtaagaaattaggtgtatttcatcatgatgacttaatgggtgatttgtcatccgctccttctatctttgaatatgaagaagacggtgttgccattcttaaagacaatattcgttatcctcaaggtacagatccaagtacaatggtaaaacaagttaccgaaaaatttagcgatattttaagtgctagttttgactcatttgaaaaacctcactatgtacctggtgatgatccactagttcaaactttacttaaggtttacgaacgtcaaactggtaaaaaaggacatgaagttgttatcggtggtggtacttatggccgattattcgagcacggtgttgcatatggtgctcaacctgaagatgcgccaatggttatgcaccaagcaaatgaatacatgaaagttgatgacttaattgattctattgctatctatgctgaagcaatttatgaattgactaaagaagct

SEQ ID NO: 31 - protein, 467 aa, Lactobacillus acidophilus
MNLDYKELAQAKKEDILRDLGELIAIDSSEDLDNTSIEYPVGPGPVKAMKKFLSFAERDGFHVKNVDNYAGRVDYGEGEKRLGVIGHMDVVPAGDGWVTDPFKMIIKDGKIIGRGSADDKGPALAAYYGMLLLKEAGFKPKKKIDFIVGTNEETNWVGINYYLKHEPTPDQVFSPDAEYPIINGEQGIYTLELNFKDDKPKGSVVLKKFKAGIATNVTPQKAFATIQADNLDEIKAKFGEFLAENNLEGHFEIDDNIAQIELTGQGAHASAPQVGRNAATFLALFLDQFDFAGRDKNYIHFLADVEHEDFQGKKLGVFHHDDLMGDLSSAPSIFEYEEDGVAILKDNIRYPQGTDPSTMVKQVTEKFSDILSASFDSFEKPHYVPGDDPLVQTLLKVYERQTGKKGHEVVIGGGTYGRLFEHGVAYGAQPEDAPMVMHQANEYMKVDDLIDSIAIYAEAIYELTKEA

SEQ ID NO: 32 - DNA, 501 bp, Lactobacillus acidophilus
  CDS (1)..(501): lspA Lipoprotein signal peptidase A (EC 3.4.23.36) ORF# 1152
atgatggtaagattagtggattattttagaaaaaattatatgcaatttttatatttaattattacattatttgttgttttagcagatcaggggttaaagaattatatagtaagtaattattcagttggtgaggttcaccagattattccaggaatcttgtcatttaattatttgcaaaataatggtgcagcttggaatattttaactaatcaaatgtggctattttattttattagtattattgcaattggtgtttgtttatactttctttttaataaaaagtataagaatgttttatttgatataggattatcttttgtacttggtggtattattggtaactttatcgatagactcagactaaaatatgtagtcgatatgttgcagttagattttgttcatttcaacatttttaatatcgcagattcagcaattactattggcgtaattcttatttttatttacttaataatttttgcagacaaggatgaaaaacatgcc

SEQ ID NO: 33 - protein, 167 aa, Lactobacillus acidophilus
MMVRLVDYFRKNYMQFLYLIITLFVVLADQGLKNYIVSNYSVGEVHQIIPGILSFNYLQNNGAAWNILTNQMWLFYFISIIAIGVCLYFLFNKKYKNVLFDIGLSFVLGGIIGNFIDRLRLKYVVDMLQLDFVHFNIFNIADSAITIGVILIFIYLIIFADKDEKHA

SEQ ID NO: 34 - DNA, 186 bp, Lactobacillus acidophilus
  CDS (1)..(186): Consensus hypothetical protein ORF# 1183
atgaatgagcaaaacgaattatctgacgcaattatcgattttcaagtaaaacatcacgttaatgatacagacttagcttttgcaagtcatctttccgtagagaaagtacacgcaatgaaaactggtgacggcaattatacagccgaagaagttaaccaactttatgattacatgtctgcaaatgct

SEQ ID NO: 35 - protein, 62 aa, Lactobacillus acidophilus
MNEQNELSDAIIDFQVKHHVNDTDLAFASHLSVEKVHAMKTGDGNYTAEEVNQLYDYMSANA

SEQ ID NO: 36 - DNA, 1245 bp, Lactobacillus acidophilus
  CDS (1)..(1245): pepT amino tripeptidase T (EC 3.411.-) ORF# 1190
atggaatatccaaatttattaccaagatttttaaaatacgttaaagttaattcacgttctgatgaacattcagatcgtttcccatcaactgaaagagaagagaactttcaaaagaatgtaattatgaaagatcttgaggaattaggcttgaaagatattcactacaatcaaaaggctggtagtgtaatcgctgaaattccttcaaatgttgattatgatgtacctgtaatgggattcttggcacatagtgatacagctgatttcaattcagaaaatgttaaaccacaaattcataaaaactatgatggtgaaagtagaattcgattaggggattcagaattttatcttgatcctgaagttttcccacatttgaaaaactataaaggtcaaactattatcactgcttcgggtgatactttacttggtggtgacgataagtgtggtgtttctgaattaatgacctttgcagaatatttgatgaatcatccagaagtaaaacatggaaagatccgtttagcatttactccagatgaagaaattggaaccggcgctgaacatttcgatgttaaagattttggtgctgattttgcttttactgttgatggtgaggctcctggtaagcttgattggggaactttctcagccgctcaatttagtctggatattcaaggggtaaatgttcatccagctgtagctaaaggtcaaatgattaatgctgttcaagtggggattgattttcataatcaattgccagaacatgatcgtccagaacatactgatggtcgtgaaggtttcttccatttgatgagttttgatggaactgttgataatgcacatttggattacattattcgtgattttgaacgtgatggtctagaagcacgtaagaatttagttaagtctactgtagataaaatgaatgcagaatttggtacagaacgtatcaaattaaagatgtgggatcaatactacaacatggctgatgaattaaagaaacacatggatatcgttgatttggcaagagatgcatataaagcagagggccttgaaatcaatgaagatccagtccgtggcggtactgatggctcacaattaacttatatgggtcttccttgtcctaatatttttgctggtgaagaaaatatgcatggccgttatgaatatactgtccttgaatctatgtataaagctgtcgatgtcatgattaaaatggcagaattaaatgctgaaagagcaagaaaagct

SEQ ID NO: 37 - protein, 415 aa, Lactobacillus acidophilus
MEYPNLLPRFLKYVKVNSRSDEHSDRFPSTEREENFQKNVIMKDLEELGLKDIHYNQKAGSVIAEIPSNVDYDVPVMGFLAHSDTADFNSENVKPQIHKNYDGESRIRLGDSEFYLDPEVFPHLKNYKGQTIITASGDTLLGGDDKCGVSELMTFAEYLMNHPEVKHGKIRLAFTPDEEIGTGAEHFDVKDFGADFAFTVDGEAPGKLDWGTFSAAQFSLDIQGVNVHPAVAKGQMINAVQVGIDFHNQLPEHDRPEHTDGREGFFHLMSFDGTVDNAHLDYIIRDFERDGLEARKNLVKSTVDKMNAEFGTERIKLKMWDQYYNMADELKKHMDIVDLARDAYKAEGLEINEDPVRGGTDGSQLTYMGLPCPNIFAGEENMHGRYEYTVLESMYKAVDVMIKMAELNAERARKA

SEQ ID NO: 38 - DNA, 1941 bp, Lactobacillus acidophilus
  CDS (1)..(1941): pepO neutral endopepdidase O (EC 3.4.-.-) ORF# 1275
atgagaagatattttgctgttcgtggcggtgcaggagatgtcgctgaaccggatgtcaatgctaaacctcaagataatttatatttagcagttaattcagaatggttatccaaagctgagattccagcagatagaatatctaccggagtaaactctgagttagatatcaagattgaaaagcgaatgatgaaagactttgctgatattgcttctggtaaagaaaaaatgcccgatattaaagattttgataaggcaattgctttgtacaagattgctaaaaactttgagaagagggatgcagaagaagctaatccaattcaaaaggatttacaaaaacttttatcattgggtagctttgtagagttggtaaaacaggctaaagatttatttatgggaccctatgtctttccatttgtatttgacgtcgatgccgatatgaagaatactgatgtgaatgctctatactttggtggtcctagtacatttttaccggatacaactacttacaaaacagatgatgctaagaagttgctagatgtattgcaagaccagagcattaacttgttgatgatggcaggaattggtaagactgaagcaaggatgtatgttgataatgctttggcatttgatgcaaaaattgctaaggttgttaaatcaactgaagaatgggctgactacgctgctatttataatccggtttcatatgacgaatttatttctaaatttaagtcatttaagatggatgaattcttaggtaaaattttacctgaaaagccagagagtgtaattgtgatggagccgcgttttcttgattatgcagaagaattgattaatgcagataactttgctgaaattaagggctggttgttagttaaatatattaatagcgtagctaaatacttatcacagaagtttcgtgaagcatcattcccatttgctcatgcaattagtggtattcctgaacttccttcacaaattaaacaagcataccgtgttgccaatggtgcattcgatgaagtagtcggtattttttatggtaagaaatactttggcgaaaaggcaaaacacgatgttgaagatatgattcataatatgcttaaagtatatgaagaacgtatcggcagcaatgattggctttcagaagacaccaagaagcaagctatcattaagttgaaagctttagttcttaagatcggttatccagaaaagattgaaaagattttcgatttacttcaagttgattcagaaaagagcctttatgaaaatgaagctgctatggataaagttcgtaccaaatatatgcttgataaattaaccaaaccggttgatcgttcggtatggctgatgccaggtaatttgaataatgcttgttatgatccacaaagaaatgatttaactttcccagcgggtattttgcaagcgccattttatgatattaatcaatctcgtggtgctaactacggtggtattggtgccactatcggtcacgaagtttctcatgcttttgataatgagggcgctaagttcgacgaacacggtaatatgaataactggtggacgaaggaagatttcgaagaatttaataagcgcgttggtaagatggttgatatctttgacggtcttcaatatggcccagctaagattaatggtaaacaagttgtttctgaaaatattgccgacttagcaggtcttgcttgtgctgtccaaaccggtaaaaatgatggtgttgacttaaaagatttgtttgaaaattatgcgagaagctggatggaaaagcaacgtccagaagcaattaaaactgaggttcaaacagatgttcatgcgccacagccaactagggttaatatccctgttcaatgtcaggatgaattctatgaggcctttggtgttaaagatacagatggtatgtggcttgacccgaaagatagaattacaatttgg

SEQ ID NO: 39 - protein, 647 aa, Lactobacillus acidophilus
MRRYFAVRGGAGDVAEPDVNAKPQDNLYLAVNSEWLSKAEIPADRISTGVNSELDIKIEKRMMKDFADIASGKEKMPDIKDFDKAIALYKIAKNFEKRDAEEANPIQKDLQKLLSLGSFVELVKQAKDLFMGPYVFPFVFDVDADMKNTDVNALYFGGPSTFLPDTTTYKTDDAKKLLDVLQDQSINLLMMAGIGKTEARMYVDNALAFDAKIAKVVKSTEEWADYAAIYNPVSYDEFISKFKSFKMDEFLGKILPEKPESVIVMEPRFLDYAEELINADNFAEIKGWLLVKYINSVAKYLSQKFREASFPFAHAISGIPELPSQIKQAYRVANGAFDEVVGIFYGKKYFGEKAKHDVEDMIHNMLKVYEERIGSNDWLSEDTKKQAIIKLKALVLKIGYPEKIEKIFDLLQVDSEKSLYENEAAMDKVRTKYMLDKLTKPVDRSVWLMPGNLNNACYDPQRNDLTFPAGILQAPFYDINQSRGANYGGIGATIGHEVSHAFDNEGAKFDEHGNMNNWWTKEDFEEFNKRVGKMVDIFDGLQYGPAKINGKQVVSENIADLAGLACAVQTGKNDGVDLKDLFENYARSWMEKQRPEAIKTEVQTDVHAPQPTRVNIPVQCQDEFYEAFGVKDTDGMWLDPKDRITIW

SEQ ID NO: 40 - DNA, 624 bp, Lactobacillus acidophilus
  CDS (1)..(624): Transcriptional repressor protein ORF# 1280
atgtctagaaaaaatagtgacaccaaacaactggaaattctacgctatatctacgatacagtagaaaatcgtggatttcctccaacagttcgtgaaatttgtgctgcggttggcttatcttccacttcaacagttcatggccatttatctcggcttgaacgcaagggttttttaatcaaagacgctactaagcctcgcgcccttgaaattacagctgaaggtaagactgaactgggtattaagccaaaagaaattcctgttgtcggagtagtcactgcaggtcaacctattttagcagttgaagacattagcgaatatttcccacttcctcctgatttagagagtgatgcaggcgaattattcatgcttaaagtccacggtaacagtatgattaaagctggcattttaaatggtgacaatgtaatcgtaagaaaacaaagtactgccaataacggagaaatagtagttgcaatgacagatgaaaatgaggccacggttaaacgtttcttcaaagaagatgatcattatcgtcttcaaccagaaaatgatacaatggcacctattattttgcaacaagtaagcattttaggtaaagtggttggtctttaccgtaacaatattcaa

SEQ ID NO: 41 - protein, 208 aa, Lactobacillus acidophilus
MSRKNSDTKQLEILRYIYDTVENRGFPPTVREICAAVGLSSTSTVHGHLSRLERKGFLIKDATKPRALEITAEGKTELGIKPKEIPVVGVVTAGQPILAVEDISEYFPLPPDLESDAGELFMLKVHGNSMIKAGILNGDNVIVRKQSTANNGEIVVAMTDENEATVKRFFKEDDHYRLQPENDTMAPIILQQVSILGKVVGLYRNNIQ

SEQ ID NO: 42 - DNA, 1461 bp, Lactobacillus acidophilus
  CDS (1)..(1461): Dipeptidase (EC 3.4.13.18) ORF# 1294
gtgttaaagttaagaggtaatagaatttataaggagaattttatgaaagaatatagtgcttgtactaccatcttagttggtaaaaatgcctcaattgatggcacaactatgattgctcgtaatgatgataccttccgcccaattactccacaaaagtttattattgagccagctcgtcatggcgaaaagaaacatattaaatcatggcttaataagtttgagatggatcttccagaagatgcacaacgagttcctgccgtaccaaatgttgattataaacatcgtggttactacgatgaaagtggtattaaccaagaaaatgttgctatgtcatgtactgaatcaacttatggtaatgaaagaactttagcatttgatccattggttaaagatggattagatgaagactgtatgcaaaccgtagttttgccatacattcattcagcacgtgatggtgttaagtatttaggtaagttaattgctaagtatggctcaccagctggtaactctgttttgttcagtgataaagatgaaatttggtacatggaaattgtaactggtcaccactgggtagcagaacgtattcctgatgattgctatgctgcaactggtaaccgtgtagctattgaacaagtcgatttcgataatcctgaatacttcatgtggagtgaaggaattcaagaatttgttgaagaacatcacttgaatccagatcatgaaggttggaatttccgtcatatctttggtacttacactgaacaagatcgccactacaatactaaccgtcaatggtatattcaaaagttgttcaacccagaaattgaacaagatccacaagatggcgatattccatttattcgtaaggcagctaagaagattaccaaggaagatattgaatttgccttaggttcacattatcaagatactccatatgatccatttggtaagggtaccgaagaagaaaagcaccgctaccgtcctattggtttgaaccgtacgcaaaatgctcatattttacaaataagaagtgatgtaccagcagaccgtgcagcaattatgtggttatgtattggtggtccaacgtttactccatttatcccattctttgctaatatgaatgaaactgatccttcatttaacaatacttcaatggattacaatatgagtgatgcatggtggtactacaagtcatttgctgcacttgttgaaagccactatccacaatttgttcaacttgatactacttatcttactgaacttaatcgttacttcagaggtcgtgttgaagaaattattaagaattcagaaggtaaatcaggcgatgaattaactgaatacttaactaaagaaaatcaaaagactgttgctcatactcgcaaggaaactgaaaagttatggggagaaatgatgattgattcaattaatatgtctaagttgacttttaatatggatgaaaatctc

SEQ ID NO: 43 - protein, 487 aa, Lactobacillus acidophilus
VLKLRGNRIYKENFMKEYSACTTILVGKNASIDGTTMIARNDDTFRPITPQKFIIEPARHGEKKHIKSWLNKFEMDLPEDAQRVPAVPNVDYKHRGYYDESGINQENVAMSCTESTYGNERTLAFDPLVKDGLDEDCMQTVVLPYIHSARDGVKYLGKLIAKYGSPAGNSVLFSDKDEIWYMEIVTGHHWVAERIPDDCYAATGNRVAIEQVDFDNPEYFMWSEGIQEFVEEHHLNPDHEGWNFRHIFGTYTEQDRHYNTNRQWYIQKLFNPEIEQDPQDGDIPFIRKAAKKITKEDIEFALGSHYQDTPYDPFGKGTEEEKHRYRPIGLNRTQNAHILQIRSDVPADRAAIMWLCIGGPTFTPFIPFFANMNETDPSFNNTSMDYNMSDAWWYYKSFAALVESHYPQFVQLDTTYLTELNRYFRGRVEEIIKNSEGKSGDELTEYLTKENQKTVAHTRKETEKLWGEMMIDSINMSKLTFNMDENL

SEQ ID NO: 44 - DNA, 1107 bp, Lactobacillus acidophilus
  CDS (1)..(1107): Xaa-pro dipeptidase (EC 3.4.13.9) ORF# 1336
atggaagaacgacaagaattacttactttaattaataatcgaattgatcaagttacctctttagttaaagaacatgatgctgatgcaatgattatttttaatcaagcaaattatcgttacttaactaactttactggtgaagaagcacagcttattttaaatgctaatggtgatcgtactcttttatcagattcacgatttgcaggacaaattaaggcccaggctcccggtgaattgaatgtagtaatgaaacgttcaagtgattatgaagaactaactaaagcacttaaaaaaatgaacgttaagaaagttttagtagagggtgaatttgtttcagctagcgaatatgaaaaattgaaggaattaaatcctgatattaaatttgaaatggttgaagaattagttgaacgtgttcgtaatgttaaagatgaacttgaaatagctgcattacgcagagcaatcgatatttccatggaaagctttaaagcaatcttaccaatgattaagccaggagtaaaagaacgagcagttggtgcgaaattggattatttgtttaaggtcaatggtggcgatggcccagattttgaaaccattattgcttcaggagtacgttcagcttgggctcatggtgttgctagtgataaagaaattgaagaaggcgacatgatcgttatcgattttggtagtttttatcatggttatgctgcagatataaccagaactgttgcattaggtgaagtcgattctgaaatgcataaaatttataatattgttcatgaagcacaacgtcgcggcatcgaagctgcagtagtaggcaatactggtcgtgatgttgataaagcagcacgtgattacattactgaacaaggatatggagaatattttggccatggaattggtcacggaatcggtctagaaattcacgaattatgtcaaccggctttgccattcagaactactaaactggtgaacaatatggttcatacagttgaacctgggatttatttaccagataaaggcggagttagaattgaagacgatattttagtgaatggtgaaacaccagaaactctgtcaactttgcccaaagatgaattaatttcttta

SEQ ID NO: 45 - protein, 369 aa, Lactobacillus acidophilus
MEERQELLTLINNRIDQVTSLVKEHDADAMIIFNQANYRYLTNFTGEEAQLILNANGDRTLLSDSRFAGQIKAQAPGELNVVMKRSSDYEELTKALKKMNVKKVLVEGEFVSASEYEKLKELNPDIKFEMVEELVERVRNVKDELEIAALRRAIDISMESFKAILPMIKPGVKERAVGAKLDYLFKVNGGDGPDFETIIASGVRSAWAHGVASDKEIEEGDMIVIDFGSFYHGYAADITRTVALGEVDSEMHKIYNIVHEAQRRGIEAAVVGNTGRDVDKAARDYITEQGYGEYFGHGIGHGIGLEIHELCQPALPFRTTKLVNNMVHTVEPGIYLPDKGGVRIEDDILVNGETPETLSTLPKDELISL

SEQ ID NO: 46 - DNA, 1197 bp, Lactobacillus acidophilus
  CDS (1)..(579): pepQ ORF# 1344
  CDS (604)..(1197): pepQ ORF# 1343
atgagtaaaacagtttttaagaattgtaatttgtttgtagggacaaaagatgaattgctacataaggcatggttcgtagttgacgaagaaacgggtaagttactccaagtgggaacagggacaaacccgaaggaagataaaaatgttgacttgcatggtcaatatgtaatgtctggattgattaatgctcatacacatgtagggttggttaatgcagccaaagaacattatcctgagactgaaactttggttacttataaggccttaaaagatttaaaaagtggattacgtgggggcgttacatatattagaagctgtggtgtagcttttgatgttgatgttaagctaaataaaatgagggatgcatatccttttgaaggacctgaaattgaaccggctgggatgccaatctctatattaggtggccatgctgatcagccattggaagataataagttaaatgttgctcacttggttaattcaccagatgatgtgagaaaagcagtgcgtgagcagtttaaaaaaggccctgaaaatattaaattaatggcgataggtggtgttatgtcacaaggtgattaaatagatgatacggaactttccttggaagaaatgcaaatggcagttaaagaggcacattctaagcacatgactgtatgtgcacatgcagaaggaaaaatggaaattcattatgctgttgttgccggagtagattctgttgagcatggtttttatgtaagtgatgaagatattgaattaatgaaaaaacaaggtacatttttatcaccaacgttaattgctggacatcaaattgtggaatatggtaaaggaaaaatgaccgatttttcatatcagaagatgtgtcagcatgtagaggcattttatgaacatgttggtaaagcaattaaagcaggtgttaaattagcgttaggaaccgatgcaggcacatttatgaatccattagaagatactgctaaagaattaaaagaattaactagagctggtacaagcaattaccaagccttacgtgctgcaggattaggatctgctgaattattaaaaattgatcgaaattatggatcgcttgaagttggaaaatatgcagattttttagtattaaagaataatccactaactgatgtaacggctgttgagcaagttgataagcaagtttatcagcatggtaagcgaaaatat

SEQ ID NO: 47 - protein, 193 aa, Lactobacillus acidophilus
MSKTVFKNCNLFVGTKDELLHKAWFVVDEETGKLLQVGTGTNPKEDKNVDLHGQYVMSGLINAHTHVGLVNAAKEHYPETETLVTYKALKDLKSGLRGGVTYIRSCGVAFDVDVKLNKMRDAYPFEGPEIEPAGMPISILGGHADQPLEDNKLNVAHLVNSPDDVRKAVREQFKKGPENIKLMAIGGVMSQGD

SEQ ID NO: 48 - protein, 198 aa, Lactobacillus acidophilus
LEEMQMAVKEAHSKHMTVCAHAEGKMEIHYAVVAGVDSVEHGFYVSDEDIELMKKQGTFLSPTLIAGHQIVEYGKGKMTDFSYQKMCQHVEAFYEHVGKAIKAGVKLALGTDAGTFMNPLEDTAKELKELTRAGTSNYQALRAAGLGSAELLKIDRNYGSLEVGKYADFLVLKNNPLTDVTAVEQVDKQVYQHGKRKY

SEQ ID NO: 49 - DNA, 2379 bp, Lactobacillus acidophilus
  CDS (1)..(2379): pepX X-Pro dipeptidyl peptidase (EC 3.4.14.11) ORF#1373
atgaaatataatcaatacgcctacgttgaaactgactttgacaaccaagttagagaacttatcgacattaactttttacctagaaactacgaagattggtcatttagcgaccttttagctaaattggtcaaaaacgcgatcgctgaagcaaagactgatgctgctaaaagtgctaaactcagcgaatttgccgtttctgatcacgaaaccttaactgattttcttaagcaaaagccagaatctatcggtaccgcacaattctataatgttgcattacaactacttggctaccatgttcattatgactatgactttgccgatccaactggttttatgcaaaaaacagcgctgccttttgttcaagatattaacgatacccataagttgatctccgctttctatcgtttgctcaatacccgtactaaaaacggtcaaattttacttgatgtgatggctggtaaaggttacttcactcaattctggggtcaaaatcaattcaaatttttcaatggtaaatctatccctgtctttgatacttcaaaagtaatccgcgaagttgtttatgtagaaaccgacttagatactgatcatgatggaaagagcgacttaattcaagttactgttttccgtccagttgaaactaacaacggtcttaaggtaccagcactttatactgcatccccatatttcggcggaatcatcgctaacgaaaagcgtaatcacagcgtcgatgaaaatctatctgatgctactgaatggaatgatccacaatacgttcattctccaatcgttaaagcagaaaagcctgatggctcaaatcatccaactactgaagaagcagttcacaagtcttcttacccattgaacgaatatatgcttgctcgcggttttgctagtgtctttgccggcgcaatcggtactcgcggtagtgacggtgtcagaatcactggtgcccctgaagaaaccgaatcagcagctgctgtaatcgaatggcttcacggcgaccgtattgcctacactgaccgtaccagaactatgcaaacaaaagctgattggtgtaacggcaacatcggtatgaccggccgctcatacttgggcactttgcaaattgctatcgctaccaccggtgtcaagggacttaagactgttgtctcagaagctgcaatttcttcatggtacgactactatcgcgaacacggtttggtcatcgctccagaagcatgtcaaggtgaagacttggatcttcttgcagaaacttgtgaatctaacttatgggatgctggatcatacctcaagatcaagccagaatacgacaaaatgcaaaagcagttgctagaaaaagaggatcggacaactggccaatattctgatttctgggaagctagaaactatcgtcatcacgctgacggtatcaagtgttcatggatttccgttcatggtttaaacgactggaacgttaaaccaaagaacgtttacaagatttggcaacttgtttctaagatgccaatgaagcatcacctcttcttgcaccaaggtccacactataatatgaacaattttgtttctatcgacttcactgacttgatgaacctttggtttgtccacgaattattggatgttgaaaacaatgcttacaaccaatggccaactgttatgattcaagacaacttgcaagccgacaagtggcatgaagaaaaagattggaacgataaattaggtcgtgaaaagatctacttccctaccgatgatgatgaacttttgcaagatggtgatagccatgccgaaaagtccttcactgatgtaggtggtattgaatttaagaaggccggtatttctgaaagtgaatgggaatacaaatttatcagcggggatgaaaaatgggctaagccaagtttgcgctttactactgatgaattcatccaccctactactattgtaggccgacctgaagttaaagttagagttaaaggatcactacctaaggggcaaatctccgttgctttagttgaacttggtgaaagacaacgtttgactgctactcctaagttcttgatgcgtggtggtcaagaattaggctacaagttcggtactgatacacttcaagaatttgttcctgataaaaagactaaggctaagttgattactaaggcacacatgaacttgcaaaactacaaggatatgaaaaagcctgagcatattgatgcagacaagttctatgatcttgatttcttacttcaacctacctactacactattccatccggaagcaagttagctttgatcatttactcaactgatgaagggatgactaagcgaccacttgaagaagaaacttacactattgatttagctaatactgaaatcaagttttatgaaaag

SEQ ID NO: 50 - protein, 793 aa, Lactobacillus acidophilus
MKYNQYAYVETDFDNQVRELIDINFLPRNYEDWSFSDLLAKLVKNAIAEAKTDAAKSAKLSEFAVSDHETLTDFLKQKPESIGTAQFYNVALQLLGYHVHYDYDFADPTGFMQKTALPFVQDINDTHKLISAFYRLLNTRTKNGQILLDVMAGKGYFTQFWGQNQFKFFNGKSIPVFDTSKVIREVVYVETDLDTDHDGKSDLIQVTVFRPVETNNGLKVPALYTASPYFGGIIANEKRNHSVDENLSDATEWNDPQYVHSPIVKAEKPDGSNHPTTEEAVHKSSYPLNEYMLARGFASVFAGAIGTRGSDGVRITGAPEETESAAAVIEWLHGDRIAYTDRTRTMQTKADWCNGNIGMTGRSYLGTLQIAIATTGVKGLKTVVSEAAISSWYDYYREHGLVIAPEACQGEDLDLLAETCESNLWDAGSYLKIKPEYDKMQKQLLEKEDRTTGQYSDFWEARNYRHHADGIKCSWISVHGLNDWNVKPKNVYKIWQLVSKMPMKHHLFLHQGPHYNMNNFVSIDFTDLMNLWFVHELLDVENNAYNQWPTVMIQDNLQADKWHEEKDWNDKLGREKIYFPTDDDELLQDGDSHAEKSFTDVGGIEFKKAGISESEWEYKFISGDEKWAKPSLRFTTDEFIHPTTIVGRPEVKVRVKGSLPKGQISVALVELGERQRLTATPKFLMRGGQELGYKFGTDTLQEFVPDKKTKAKLITKAHMNLQNYKDMKKPEHIDADKFYDLDFLLQPTYYTIPSGSKLALIIYSTDEGMTKRPLEEETYTIDLANTEIKFYEK

SEQ ID NO: 51 - DNA, 4881 bp, Lactobacillus acidophilus
  CDS (1)..(4881): prtP precursor ORF# 1512
atgagaaataaaaaagtggggagtgtaactacagactacagttaccttaatcaatctaggaaccatttaaatttagtaactggtaaagaaaatgatagtaaattaaaaatttggcgaaaaaattttgctacagctgctattattgcattagcatctggcactacaatgttgttttcagctcattctgtaaaggcagatgaagttgatgatattactgttcaaaatgataaacaagtaaatactacgattgtacaaaataataaagatcaacaatcatctgatacacaacaaaatgtaaatgagaatagggcaagcagccagcaagctataagaagaccagggactggtaacaagttaacagatcaatggcctgataattatcaatcagatcaacaaaataatagttctcaagctgaaactacaaaaatttctaccactggttattctaatcaaactgaacagcaatcaaataatactgtaccgtctacagtagccagttcgacagtatataaagaatcaagcgatgatcaagctggacaaaaagatactaatggtgttgagcttccagctaataaccaagaccatattaagggaaatgttcaggatgcttgggatcaaggctataagggacaacatactgtagttgcagttattgattcaggtgttgatacaagtcataaagactttcaaacgatgcctgaaaatcctaagctttctcaagctgaaatagaagcgttgatcgcaaaattaggttacggtacttatataaattctaagtttccttttgtgtacaatgcagtagatcatgaaaaccaaagtatgaaagggcctgatggtgagcctcacggtcaacatgtttcaggaattatagctgctgatggtcaaccaaatggtgatcaagaatatgtggttggagttgctccagaagcacaattaatgcattttaaagtctttggcgacaatgctacttcattagacttagcacaggaaatctatgatgcaactaatttaggagcagacgtaattcaaatgtctttaggtggaggggttgcagctgctgatctcaatgttgcagatcaaagagcggttcaatatgctattgatcatggtgtaattgtttctatctcagcttctaataacggtaatgctgcttcaattcaaaatccaagcaatgttactgacttagataattatgaagctggtacacatgtgggtaactatgaacctttcagctctagtactgttgcggatcccggtgctgctcgtggtgccattactggagcagcagaaacatcaggcttgggtgataaaagtgatatggcaacattcacatcttggggaccattaccagattttactttgaaacctgatgtctctgcgcctggtagcaatgtgatttctttggctaatgacaacggttatactactatgagtggtacttcaatggcaggtccgtttattgccggtgctgctgcattagttagacaaagattgcaacaaactaatcctgaattaaaaggtgcagatttggtagcagctgtaaaagcactattaatgaatactgctgatccgcaaattcaacaaggcttcacaactattgtttctccaagaagacaaggtgctggtcagattaatgttggtgcagcaactaaagcacctgtttatattttagctaatgatggtacaggctctgttagtttacgtaacattaaagaaacgactaattttgaactaactttccacaatttaactgataatacagaaacttatacttttgatgatttaggtggtggttttaccgaggttagagatactgatactggattattccatgatgttcaattagcgggcgcacgagttactggtcccaatactattacggtaaatcctaaagagactaaaaaaatagtatttactttaaatttaactggcttaaagcagaatcaattggttgaaggatatttgaattttactaattctaaggataagttgtctctgtcagtaccttatttaggctactatggtgacatgacatctgaggatgtctttgacaagaaagctaacgaagataagccagatattaaaggtaatcgcttaacaaatgaagacaattacccacgtgggattgctgatgaagaatcacttaaagaattagttaatattgaaggtaactataattggcaagaagttgctaagctgtatgaaagcggtaaggttgcattttctcctaatggtgacaataagagcgacttaattatgccatatgtatatttaaagcagaatcttcaagatttaaaggtagaaattctagatgctaaaggaaatgttgttcgtgtattagcagatgcacatggtgttcaaaaatcttataacgaagatggtactggtaccgttgatgccttaattagtgttgattctggtaaatttaattgggatggtaaagtttataattacaaaacgggtaaaatggaagttgcaccagatggtcaatatacttatcgctttgttgctacgctttacaatgatggaccacataaggttcaaaccaatgatacgtcagtaattattgatactactgctccaattttaaaagatgtagaatatgatgttactactaaaactattactggaacatattctgatgcaggtgcaggatttactgattattcatatgctactgtaactataaatgatcgagtttttggttttaaattaaacgataatgataattcaacatttgataatactgacaagactataggacattttagttttgctttaactcctttagaacaacaggctctaactgctgctcataataaagtgagtgtttgtttaagcgatgtggcagataatactgctgttaaaacacttgatgtagcaagtgtgggtgatggtaacaagattgctatttggaatgctgttaatggtgtaccatttaattccaattctcaagattatagtgataagaataatagttacttattacgtggtagtgctactgaaaacttctacgttaatggtaagttagtgcaagttgctccaaatggtgaatttgttttaccggtttctttagatgaacaaaatttagtatttacttctgatgaaaatggccaaaatgtgctaagacaatttaccacctatactcctaaagctgattttgcttggcagcatattgatggtagtgaaagatcatttggtgtttcagtttattcaattgatgcagctgatccaaatgatgcaatagttcaagcagcagtgccaaaaggaaataatgttaaggcttttgcaaaagattactttactggtgaaacatatgttggtgaagtaaaagatggtgtagcaacattccatattcatacttcaattaatccggatcctcaaacgggtattaatcgtcgagcccttttacaaggttgggttgaaattgatggaccaacttataatgctaagcaagtaacagatccgactgccattagtgatagaaattatattggtgtttattacaaaccagatgcttcatctcatgtttatagtaatcgtgatgagctaggcgtagatgattttactgatgaacaagcagatgtgtcggattttggaccaagtaaattcctgtatccaggccacaatgccccaagtgatggtaatgcaaatatttcatttgattatgtaaatgataataatataagtacgtttggacaagaagcagttaaagcaggttattatgatcctattgctaaagtattcactattacaggtcatgtagataaagatgtagttagtttggttgctttacaagataatccaaatgaagatgcacctgaaaatcgggttgcaattgataaagatggtaattttataattaaattccacatggatgatccgtctacaagacaacttacttatatttataaggtaaaggattcatcaacagataagattgatacggttaaaggttcgattactcttattcttgatacagttttgccaactttgcatgttgatcaattaaatggtgctgacaacttaacaattacaactaataatccaacatttaaaatttctggtaatgctaacgatgacttggatgactatagtgtatacattaatggtgataatgtatttactcaatttaatggttcaagcttcaattatattccaggaatgtatggtgacccaaatcaaaaaacacctaacttatatggaggctatgactttgagcaagaagtaaatcttgatgatgagaatggaaagccaactacacatatctttaatattgaattaattgatcaagtgggtaataaagtattcaaaactttaacggtcaactacgatccaaatgccactaactctgaagacccaagtaacggtacaggtgacagtggaattgaagttgttccaactgtaccaagaaaagttcaacctctttcggatgataattcaactaacattaatgataagcaaactttatctactgaattaacgattactttgccaagaaatatctttgcatttgattatcaaggtaaagtagccagaaaacatggtaaagatattattttgaagaagggcgttgttttatacaatcctaaagaagtaaatattagaaaacataaatattataaagtaagtaagaatgtctacattaaggtgacatcaacgagagtaaataaaaaacttaagcgacttattttgatcaagaattcttatgtttataatttaaacggaaaagcaaataaagttcataataaacgtgttctacttaagcggggattagccgttgatgtcttacatggtggtaagattactaaagtaggcaaatatgattgttatcaaattggtatcaatcaatacattaaagtagctaatacagctttgaaa

SEQ ID NO: 52 - protein, 1627 aa, Lactobacillus acidophilus
MRNKKVGSVTTDYSYLNQSRNHLNLVTGKENDSKLKIWRKNFATAAIIALASGTTMLFSAHSVKADEVDDITVQNDKQVNTTIVQNNKDQQSSDTQQNVNENRASSQQAIRRPGTGNKLTDQWPDNYQSDQQNNSSQAETTKISTTGYSNQTEQQSNNTVPSTVASSTVYKESSDDQAGQKDTNGVELPANNQDHIKGNVQDAWDQGYKGQHTVVAVIDSGVDTSHKDFQTMPENPKLSQAEIEALIAKLGYGTYINSKFPFVYNAVDHENQSMKGPDGEPHGQHVSGIIAADGQPNGDQEYVVGVAPEAQLMHFKVFGDNATSLDLAQEIYDATNLGADVIQMSLGGGVAAADLNVADQRAVQYAIDHGVIVSISASNNGNAASIQNPSNVTDLDNYEAGTHVGNYEPFSSSTVADPGAARGAITGAAETSGLGDKSDMATFTSWGPLPDFTLKPDVSAPGSNVISLANDNGYTTMSGTSMAGPFIAGAAALVRQRLQQTNPELKGADLVAAVKALLMNTADPQIQQGFTTIVSPRRQGAGQINVGAATKAPVYILANDGTGSVSLRNIKETTNFELTFHNLTDNTETYTFDDLGGGFTEVRDTDTGLFHDVQLAGARVTGPNTITVNPKETKKIVFTLNLTGLKQNQLVEGYLNFTNSKDKLSLSVPYLGYYGDMTSEDVFDKKANEDKPDIKGNRLTNEDNYPRGIADEESLKELVNIEGNYNWQEVAKLYESGKVAFSPNGDNKSDLIMPYVYLKQNLQDLKVEILDAKGNVVRVLADAHGVQKSYNEDGTGTVDALISVDSGKFNWDGKVYNYKTGKMEVAPDGQYTYRFVATLYNDGPHKVQTNDTSVIIDTTAPILKDVEYDVTTKTITGTYSDAGAGFTDYSYATVTINDRVFGFKLNDNDNSTFDNTDKTIGHFSFALTPLEQQALTAAHNKVSVCLSDVADNTAVKTLDVASVGDGNKIAIWNAVNGVPFNSNSQDYSDKNNSYLLRGSATENFYVNGKLVQVAPNGEFVLPVSLDEQNLVFTSDENGQNVLRQFTTYTPKADFAWQHIDGSERSFGVSVYSIDAADPNDAIVQAAVPKGNNVKAFAKDYFTGETYVGEVKDGVATFHIHTSINPDPQTGINRRALLQGWVEIDGPTYNAKQVTDPTAISDRNYIGVYYKPDASSHVYSNRDELGVDDFTDEQADVSDFGPSKFLYPGHNAPSDGNANISFDYVNDNNISTFGQEAVKAGYYDPIAKVFTITGHVDKDVVSLVALQDNPNEDAPENRVAIDKDGNFIIKFHMDDPSTRQLTYIYKVKDSSTDKIDTVKGSITLILDTVLPTLHVDQLNGADNLTITTNNPTFKISGNANDDLDDYSVYINGDNVFTQFNGSSFNYIPGMYGDPNQKTPNLYGGYDFEQEVNLDDENGKPTTHIFNIELIDQVGNKVFKTLTVNYDPNATNSEDPSNGTGDSGIEVVPTVPRKVQPLSDDNSTNINDKQTLSTELTITLPRNIFAFDYQGKVARKHGKDIILKKGVVLYNPKEVNIRKHKYYKVSKNVYIKVTSTRVNKKLKRLILIKNSYVYNLNGKANKVHNKRVLLKRGLAVDVLHGGKITKVGKYDCYQIGINQYIKVANTALK

SEQ ID NO: 53 - DNA, 1281 bp, Lactobacillus acidophilus
  CDS (1)..(1281): Peptidase T ORF# 1515
atggctttttatgatttgaaatatttagaagacacttttattcattatgttaagcaaaatactagatcttatgaagaaaatcatgatcaggttccctcatcacctaatcaagttaagatgggaaaagaacttgcgaaagctctaaaagaaataggtcttgttgcatattataatgaaaaaaatggttttgccattgggtatttaaagaaaaatgttgaagacgatgtaacaccgattggctttttctcacatattgatacggctgatttcaatgccgaaaatattaagcctcaaattcatcgcaattatgatggtaagaggattgctttagataaagagaataatatttatcttgatcccaaagaattccctgccttggctagttgtaaaggcgaaactttgattacttctgatggtcacactttgcttggaacagatgataaagcagggattgttgggattttagggatgcttaagtatttgagcgaacatcctgagattgagcatggtgatatttatattggctttggtccagatgaagaaattggatatggtggtcaaagatttgatccccaagattttcctggtgtcgaattagcctatactttagaaaatggacgaccaggtgactttgaatatgagacttttaatgcaactgaagcacaaattcacattcgcggtacggtcgttcatccaggtgaggcgtatggcttaatggtgaatgcgaccagcctaatgaacgaatttttgaatcaattgccaaaagatgaagttccggaaaaatctaaaaatcatgatggctttattttggtattaaatgccgcaggttcagtagatcatgcagatattagtttaattattagggattttgactgggataaatttaccgctaaagagcaactaattgaggaaattgttgcaaaacttaatcagaaatatggcgaacgtttttcattaaagatgcgtcggcaatatgaaaatatctataatgtgattaaagacaagccttatgtggttaatctagctcttgatgcgtataaaaagttggggattaagcctcacattcaaacatttagaggtggaacagatggtaactttatcacgcaaaaaggtatcccaactcctaatttattcaatggtggtgggaattatcatggtcgctatgaatatgcaactgttgagcaaatagataagttagcggaagtattaactgaaattgtcaaagaacatttatatcaaacgcgtcatggacgtaataattcaccattgatcaaatattgg

SEQ ID NO: 54 - protein, 427 aa, Lactobacillus acidophilus
MAFYDLKYLEDTFIHYVKQNTRSYEENHDQVPSSPNQVKMGKELAKALKEIGLVAYYNEKNGFAIGYLKKNVEDDVTPIGFFSHIDTADFNAENIKPQIHRNYDGKRIALDKENNIYLDPKEFPALASCKGETLITSDGHTLLGTDDKAGIVGILGMLKYLSEHPEIEHGDIYIGFGPDEEIGYGGQRFDPQDFPGVELAYTLENGRPGDFEYETFNATEAQIHIRGTVVHPGEAYGLMVNATSLMNEFLNQLPKDEVPEKSKNHDGFILVLNAAGSVDHADISLIIRDFDWDKFTAKEQLIEEIVAKLNQKYGERFSLKMRRQYENIYNVIKDKPYVVNLALDAYKKLGIKPHIQTFRGGTDGNFITQKGIPTPNLFNGGGNYHGRYEYATVEQIDKLAEVLTEIVKEHLYQTRHGRNNSPLIKYW

SEQ ID NO: 55 - DNA, 1530 bp, Lactobacillus acidophilus
  CDS (1)..(1530): Aminopeptidase ORF# 1567
ttggaggtaaaacgtatgaaaaaaagaacaacacttttattatcaagtgcaataacaattgcagcattatttagttttaattcaaaggctcaggccgctgccgatcccgcagtcaaagcaaccaactacaatatgactgtaaaactaaatactcgcaaaaatcaactaaccgaaaaagttaccatgcatgtcgttaataacggcaatgaaccagttaagaacttactgatcagaaatattgctaatggtgttttaaagtatgaccatcagcattttaaaattgccaaaaatgcaaaaactacagttaaaagtatttcctcagctggagaaaatctttcctataccactggcaaagataagagcaacctattcgttgataaaagcttaaatgcaggtgaatctaccgacttaactgttaatgtagtcaccagcgttcccaaaagacaagatcgttttggctaccaaaatattaatggcggtaaagtttataacttatccttctgttttccttacctaagcgattatcgcaacggaaaatggaattaccatccatattatgacggtggtgaaaaccgtaataccactgtcagcaattttcatgttagcttttatgcaccaaagagttacaaggttgctgcttcaggacaaaatagcaccaaaaatggcaagactacaatcgttgcggaaaatatgagagattttgctatcgttgcttctaataaattcaaggtttctcatacttatgcagatggtataagaattaataattattattttgccggtaaaaatagtaagcaatataacaaacttgccttattgactgctaaagatagtttcaatattttcaccaagaaaattggtaaatatccttataaagaaatcgatatgactgaaggcttacttggtaaagataccggtggaatggaatatcctagtttaattatgatcgatgcgagtggctttgtacaaaagaaacacccaatcaacagatacaatgaattaaccgaagatgtttcccatgaaattggtcaccaatggttctacgctactgttggcaatgacgaatacaccgagccatggcttgatgaaggacttactaatttccttgaaaacagtgtttatgatttaacttatactaagagtaaagcctatactgctaaacttatgcacaacaaactttataatcgtaaaacagtgaaaaaggcaaatcaagttctggctaacttagctaatacctttttaaccgatcatcgtcaaaaaggtatctacgttaaccgtcctctcaacaatccaccaaaaggaatcgatactgacgagatggcttatgaagccggtagttctttcccagcaatcttaatgatcgctatgggtaaaaagaaattctttaatgctttgcatgattactatgaaacctactacttaaaacaagctactacacaggattttttgaatatcattcgtaagtatgacaactcaaagaaagtaaactatgtgattaatcaatttatcgatcctgattatttgaacaaa

SEQ ID NO: 56 - protein, 510 aa, Lactobacillus acidophilus
LEVKRMKKRTTLLLSSAITIAALFSFNSKAQAAADPAVKATNYNMTVKLNTRKNQLTEKVTMHVVNNGNEPVKNLLIRNIANGVLKYDHQHFKIAKNAKTTVKSISSAGENLSYTTGKDKSNLFVDKSLNAGESTDLTVNVVTSVPKRQDRFGYQNINGGKVYNLSFCFPYLSDYRNGKWNYHPYYDGGENRNTTVSNFHVSFYAPKSYKVAASGQNSTKNGKTTIVAENMRDFAIVASNKFKVSHTYADGIRINNYYFAGKNSKQYNKLALLTAKDSFNIFTKKIGKYPYKEIDMTEGLLGKDTGGMEYPSLIMIDASGFVQKKHPINRYNELTEDVSHEIGHQWFYATVGNDEYTEPWLDEGLTNFLENSVYDLTYTKSKAYTAKLMHNKLYNRKTVKKANQVLANLANTFLTDHRQKGIYVNRPLNNPPKGIDTDEMAYEAGSSFPAILMIAMGKKKFFNALHDYYETYYLKQATTQDFLNIIRKYDNSKKVNYVINQFIDPDYLNK

SEQ ID NO: 57 - DNA, 1296 bp, Lactobacillus acidophilus
  CDS (1)..(1296): D-alanyl D-alanine carboxypeptidase ORF# 1603
atggtttttagtaaaaaaataaaacggacattaattagtcttgttgctttagtttctttagtttcttgtggtgcagtatttacaacaccggttagtgcagatacatcaagtagttatcgcaataatgaagtgaatttagatgttaaatctgcaattgcaattgatagtaattcggggcaaattttgtatgctaaaaatgctgataagactttaccaattgcttcaatgacaaagttaattacagtttatttaactttaaatgcaattaaaaataaaaaattatcttggaatcaaaaggtgaagccaactgcttcaattgtaaaagtagctaataatgcggaatattcaaatgtaccgcttaagatggggcattcttatactattcgtcagctttatcaagcaactttaattgaatcagctaatggggccgcaatgcttttgggccaaactattgctggttcacaaaagaaatttattgatcaaatgcgtgcccaagttaaaaaatgggggattgaagatgccgagatttatacggcatgtggtttacctaatggtaatgtaggtaaagatgcctatcctggtgtaaataagaatgctgaaaatactatgtcagctaaggatatggccattgttggacaacatttacttaaagaatacccagaaattttagatactactaaattagctcatttagattttaaagacggtaataaaactactaaaatggccaactttaactggatgcttaaaggactttctcaatatgatcaagcatatccagttgatggattaaagactggtaccactgatgcagcaggtgcatgttttattggtacagttgaacataatggtgctcgtttgattactgttgtcatgggtgcacgtcaccaagatggtacggatccttcacgttttattcaaactaagaaattaatgagttttattttcaacaaataccgtccagttacaatgactgctggaagtcaaataaatggtgcaaaaagtattaaagttactgatggtaaagacgctacaactaatattggtttaaagaataagacaactatttgggatccagcagatggtaaaacattgactgctagtttaaacaaaaaaacaatagatgcgcctcttgaaaagaatcagacagttggtaattatcaattaaaatcaggtagtgaaaaaattgtttcattggataatcctaatggaatgaatgtaaaagctaaagctttatcagctaatggaaaagttaatttctttgttagaatttggcgttggcttttcgggggcaga

SEQ ID NO: 58 - protein, 432 aa, Lactobacillus acidophilus
MVFSKKIKRTLISLVALVSLVSCGAVFTTPVSADTSSSYRNNEVNLDVKSAIAIDSNSGQILYAKNADKTLPIASMTKLITVYLTLNAIKNKKLSWNQKVKPTASIVKVANNAEYSNVPLKMGHSYTIRQLYQATLIESANGAAMLLGQTIAGSQKKFIDQMRAQVKKWGIEDAEIYTACGLPNGNVGKDAYPGVNKNAENTMSAKDMAIVGQHLLKEYPEILDTTKLAHLDFKDGNKTTKMANFNWMLKGLSQYDQAYPVDGLKTGTTDAAGACFIGTVEHNGARLITVVMGARHQDGTDPSRFIQTKKLMSFIFNKYRPVTMTAGSQINGAKSIKVTDGKDATTNIGLKNKTTIWDPADGKTLTASLNKKTIDAPLEKNQTVGNYQLKSGSEKIVSLDNPNGMNVKAKALSANGKVNFFVRIWRWLFGGR

SEQ ID NO: 59 - DNA, 1425 bp, Lactobacillus acidophilus
  CDS (1)..(1425): Dipeptidase (EC 3.4.13.18) ORF# 1646
atgaaaaaagataattgtactgcaatcctagtaggtaaagacgcttcaattgatggttcaaccatgattgctcgtgatgaagatgggtacggcggcatcaacgaaaagctttttgtcgtaaataaggctcgtcactacgatgaagactatgtttcaaaatacaacggctttaagatgcaccttgaaggagatggctgcaagtggactgctgctccaacggcagatgattcagaaggtcgctgggatgaacaaggtatcaacgaatataacgtggctatgtctgctacggaaactgaagcaactaatgcgcgttgcttaggccatgatccactagtggcagatggaattaacgaagactccatggtttacattaccttgccttttgttaaaactgctcgtgaaggggttaagcgtttaggccgcttgattgaaaagtatggtactggtgaaagtaatgggattgccttttccgataataaagaagtttggtatcttgaaactggtgcgggtcaccaatgggtagctgcacgtattcctgataattcttatgctatttgccctaacattatggtaattcaagatgttgatttttctgatcctgataactttatgtggagtgaaggtatccaggaatttgtcgaaaagaatcacttaaataatagtacagatggtagtttttcatttagagatatttttggcaccaaggatgaagctgatgctttttacaacacaccaagaacttggtatggtcaaaagttgttcaacccaagtattgaacaagacccaaccagtcaagaaatgccatttactcgcgttcctgaaaagaagattggcgttgaagatgtacaaaagtttttaactagtcactataacggtacgccatatgatccaatggatactttctcatccggcagcgaaaaagaacaaaagatgttccgttcaattgcgttggatagaaaccaagaatccagtatcttgcaaattagaaatgatgttcctgctaagattgctggtgttcaatgggtaaactttggcttttatgcatattctccatatgttcctttctacacgaacattgaagatactccacttaactacaaagtggcagaacatacagttgatccagatagcagtgcttactggctttacaagactttgcaagtaattgttgaaccacgttatcaccaatacatttatgaagtaaatgcttaccgtgatgattgtcaaagttatggtattggtcgtattgatgaaatcgacgaaaaagccaaagacttagaaggtactgaattaattaattatttaactaatgctaatgatgctactgctggtgtaattactaaaaagactaagactttaatgagtaatttagtaagacaagctttaaatagttcaaaatatcaatttgaacgtggtgataattta

SEQ ID NO: 60 - protein, 475 aa, Lactobacillus acidophilus
MKKDNCTAILVGKDASIDGSTMIARDEDGYGGINEKLFVVNKARHYDEDYVSKYNGFKMHLEGDGCKWTAAPTADDSEGRWDEQGINEYNVAMSATETEATNARCLGHDPLVADGINEDSMVYITLPFVKTAREGVKRLGRLIEKYGTGESNGIAFSDNKEVWYLETGAGHQWVAARIPDNSYAICPNIMVIQDVDFSDPDNFMWSEGIQEFVEKNHLNNSTDGSFSFRDIFGTKDEADAFYNTPRTWYGQKLFNPSIEQDPTSQEMPFTRVPEKKIGVEDVQKFLTSHYNGTPYDPMDTFSSGSEKEQKMFRSIALDRNQESSILQIRNDVPAKIAGVQWVNFGFYAYSPYVPFYTNIEDTPLNYKVAEHTVDPDSSAYWLYKTLQVIVEPRYHQYIYEVNAYRDDCQSYGIGRIDEIDEKAKDLEGTELINYLTNANDATAGVITKKTKTLMSNLVRQALNSSKYQFERGDNL

SEQ ID NO: 61 - DNA, 915 bp, Lactobacillus acidophilus
  CDS (1)..(915): Prolyl aminopeptidase (EC 3.4.11.5) ORF# 1658
atgaaaactggtactaaaattatcactttagacaacggttaccacttatggactaatactcaaggtgaaggcgacattcacttattagctcttcacggtggtcctggcggcaaccacgaatattgggaagacactgcagaacaactaaaaaaacaaggcttagacgtccaagttaccatgtacgatcaacttggctcactctactcagatcaacctgactattctaatcctgaaattgctaaaaagtatttaacttatgaatacttcttagatgaagttgatgaagttcgtgaaaagctcggtttagacaatatttacttaatcggtcaaagttggggtgggttattagttcaagaatacgccgttaaatatggtcagcacttaaagggtgcgatcatttcatcaatggttgatgaaatcgacgaatatgttgcatcagttaatcgtagacgtcaagaagttctaccacagactgaaattgattttatgcatgaatgtgaaaagaacaatgattacgacaacaaacgttaccaagatgacgttcaaatcttgaacattaactttgttgatcgtaagcaaccttcaaagctttaccatctaaaggaccttggtggttctgctgtttacaacgccttccaaggtgataatgagtttgttatcaccggtaagttaaaggactggcacttcagagatcaattacacaagatcaatgttccaactttgcttacttttggtgaaaacgaaactatgcctatttcaactgctaagattatgcaaaaggaaattcctaactcacgtttagttactactccagatggtggacaccaccacatggttgataatcctacagtttactataaacacttggctgacttcattcgtgaagtagaaaacggcacctttaaaggccaaaat

SEQ ID NO: 62 - protein, 305 aa, Lactobacillus acidophilus
MKTGTKIITLDNGYHLWTNTQGEGDIHLLALHGGPGGNHEYWEDTAEQLKKQGLDVQVTMYDQLGSLYSDQPDYSNPEIAKKYLTYEYFLDEVDEVREKLGLDNIYLIGQSWGGLLVQEYAVKYGQHLKGAIISSMVDEIDEYVASVNRRRQEVLPQTEIDFMHECEKNNDYDNKRYQDDVQILNINFVDRKQPSKLYHLKDLGGSAVYNAFQGDNEFVITGKLKDWHFRDQLHKINVPTLLTFGENETMPISTAKIMQKEIPNSRLVTTPDGGHHHMVDNPTVYYKHLADFIREVENGTFKGQN

SEQ ID NO: 63 - DNA, 1794 bp, Lactobacillus acidophilus
  CDS (1)..(1794): pepF oligopeptidase (EC 3.4.24.15)
atggcaattccaacaagaagtgaagttccagaagaattaaaatgggacttaacccgtgtttttaagacagatgaagactgggaagcagcctttgataatgcaaaagatgaagtagaaaaattaggtgattttaaaaaaatccttactaaatctggcaaagacttatacgaaagtttgacccaaattttagcagttaaacgtcaagtagaaaatatttacgtttatgcaactatgtctagtgatgttgatacttcaaattctcactatttaggttatgtaagccgcgcacaaaatttagttaaccaatttgaggcagtaactagttttatcagcccagaaattctgagtatccctgccgataagtttgaacaattcaaaaaggatgaacctcgtttaaacgattatgctcactatcttgagacaatcactaataagcgtccccacactttacctgctgaagaggaaaaaattatcgcagatgccagtgatgccatgggcgtttcagaaaatacctttaacgttttaactaattcagacatggaatatggctacgttcaagatgacgatggtaatatggaacaattgtctgacggtttgtactcacttttaatccaatcacaaaaccgtgatgtcagaaaaggcgcttttgatacgctttatgcaagctatggtcaattccaaaattcacttgcttctacgctttccggcgttgtaaagaagcacaattataacgctaaagttcacaagtatgattcagctcgtgaagcagctttagctgaaaacaacgtacctaccaaggtttacgacactttgattcgagaagttgactcccatcttgatttacttcaccgttatgtagcacttcggaagaaaattttgggacttaaagatttacaaatgtgggacatgtacgtgccactaactggtaagcctgctctttcatataattttgaagaagcaaaggaagtagctaagaaagctttagctccactgggcgaagattacttaaagcatgttgattatatctttaataatcgcgtaattgatgtagttgaatcaaagaataaagtaactggcgcatattctggcggtgcttatgatacagatccatatgaacttttaaactgggaaaacaacattgactccttatatactctagttcacgaaactggtcactcagttcactcttggtacactcgcaatagccaaccttacgtttatggggattatcctattttcgtagcagaaattgcttcaaccactaacgaaaatattttgactgaatacttcttagatcatattactgattctaagacacgcgcctttattttgaactactatcttgattcatttaaggggacattgttccgtcaaacccaatttgcggtgtttgaacaatttattcatgaagcagatgctaaaggtgaaccacttactgctgatatcttggatgaagtttatggacaacttaaccaacactattacggtgacagcgttgagccaggcggcgatattgcacttgaatggtcacgtatcccgcacttctactacgacttttacgtttaccaatatgcaacaggatttgcggctgcaacagctcttgccaacaaggtggttcatggttctgaagctgatagggatgcatatcttggttttcttaaggctggttcaagtaactatccaaccgaaattatgaagcatgctggcgttgatatgactaagccagactacttggaagatgcatttaagacatttgaaaaacgtttagccgaatttgaaagtttgattgaaaaa

SEQ ID NO: 64 - protein, 598 aa, Lactobacillus acidophilus
MAIPTRSEVPEELKWDLTRVFKTDEDWEAAFDNAKDEVEKLGDFKKILTKSGKDLYESLTQILAVKRQVENIYVYATMSSDVDTSNSHYLGYVSRAQNLVNQFEAVTSFISPEILSIPADKFEQFKKDEPRLNDYAHYLETITNKRPHTLPAEEEKIIADASDAMGVSENTFNVLTNSDMEYGYVQDDDGNMEQLSDGLYSLLIQSQNRDVRKGAFDTLYASYGQFQNSLASTLSGVVKKHNYNAKVHKYDSAREAALAENNVPTKVYDTLIREVDSHLDLLHRYVALRKKILGLKDLQMWDMYVPLTGKPALSYNFEEAKEVAKKALAPLGEDYLKHVDYIFNNRVIDVVESKNKVTGAYSGGAYDTDPYELLNWENNIDSLYTLVHETGHSVHSWYTRNSQPYVYGDYPIFVAEIASTTNENILTEYFLDHITDSKTRAFILNYYLDSFKGTLFRQTQFAVFEQFIHEADAKGEPLTADILDEVYGQLNQHYYGDSVEPGGDIALEWSRIPHFYYDFYVYQYATGFAAATALANKVVHGSEADRDAYLGFLKAGSSNYPTEIMKHAGVDMTKPDYLEDAFKTFEKRLAEFESLIEK

SEQ ID NO: 65 - DNA, 1419 bp, Lactobacillus acidophilus
  CDS (1)..(1419): Cytosol non-specific dipeptidase (EC 3.4.13.18) ORF# 1837
gtgaattttatgaatactacagtcgttggtcgttcgtcttgtacctcaatcttaattggtaagaaagcatccctttcaggcagtgtaattattggccgcaatgaggatgcaaaaactgcttggccaaaacatcttgcattcaatcaccataagaatgttaagaataaccattttaagtcaaaagacaataaatttgaaattgatttacctgaaaagatattcagctattcttccacaccagaatggacagataaatacggtgtttttgaagaagatggcattaatgagtatcatgtggcaatgagtgctactgaaagtgcctatgccaatgatcgtgtaatggcagttgatccattcaatacagaaaagggcatcctagaagaagctatggtaacggtagtattgccatatattaaaacagcaaaagaaggcgttattcgcttaggcaaaatcgttgaaaaacatggtgccgctgaagcagacgggatcttatttgctgaccgcgacgaagcatggtacatggaaattggatcaggtcaccactgggttgctcaaagaattccagatgattcatatgcagtagttgctaaccaattagcaattcaagaaattgactttgacagtgacaatttcttatattcaaataatttacaaaattttgtttataacaatcaactttggccaaaagataaaccatttatttggcgtgatatttttggtacacatgacgatagtgatcttcattacaatacgccacgtgtttggagcggtcagcgtcttttaacgccatctgctgaacaaaagcctcaagacttcaatttaccatttaccagaaagcctgatgcgcctatttctgcccaagatgctcaacatgttttaagtgatcactttaataatacagtttatgatctaacaaataagaaaaataaagatcagcctgcatttcgtccaatttctgtagctactactcaagaatcacatttgcttgaattaaacggcgaagacatgattcattggctagcaatgggcgttgccgcacaaagcgtatatattccgttctatccacaaggtactaaagttcctagtacctggaaaaacggtaaagagacttattcaccgaattctgcctactgggtatttaagcttgccagcgttttagttgatcgcgattggagtaagtacggtactgcattgagtaatacccaaaactctactaatgagaaattattgcaaattagacatcaatatgatgaaaaattagctaaggaaaatgatcctgctaaacgaactgatttaattaatgaagcaaatgctaaactggctaagacagctacagacgcatataaagaattaactgcaaaattgattactgaacaaactggtgattcaccacttagattccaaatggatcctaaccta

SEQ ID NO: 66 - protein, 473 aa, Lactobacillus acidophilus
VNFMNTTVVGRSSCTSILIGKKASLSGSVIIGRNEDAKTAWPKHLAFNHHKNVKNNHFKSKDNKFEIDLPEKIFSYSSTPEWTDKYGVFEEDGINEYHVAMSATESAYANDRVMAVDPFNTEKGILEEAMVTVVLPYIKTAKEGVIRLGKIVEKHGAAEADGILFADRDEAWYMEIGSGHHWVAQRIPDDSYAVVANQLAIQEIDFDSDNFLYSNNLQNFVYNNQLWPKDKPFIWRDIFGTHDDSDLHYNTPRVWSGQRLLTPSAEQKPQDFNLPFTRKPDAPISAQDAQHVLSDHFNNTVYDLTNKKNKDQPAFRPISVATTQESHLLELNGEDMIHWLAMGVAAQSVYIPFYPQGTKVPSTWKNGKETYSPNSAYWVFKLASVLVDRDWSKYGTALSNTQNSTNEKLLQIRHQYDEKLAKENDPAKRTDLINEANAKLAKTATDAYKELTAKLITEQTGDSPLRFQMDPNL

SEQ ID NO: 67 - DNA, 2532 bp, Lactobacillus acidophilus
  CDS (1)..(2532): Aminopeptidase N (EC 3.4.11.2)
atggcagtaaaacgtttttatgaaactttccatccagaacattacgatttacgtattgatgtaaaccgtaaaaataaggaaattaatggtacttctactattactggtgatgtagttgagaatccagtatttattaatcagaagtttatgactatcgacagtgttaaagttgagggaaaagacgttgattttgaagtagttgaaaaagacgaagcaattaaaattgaaaccggcgtaactggtaaagccatcatcgaaattgcttatagtgcacctttgacagatactatgatgggtatttatccttcatattacgaattggaaggtaaaaagaagcaaattattggtacgcaatttgaaaccacttttgcgcgtcaagcatttccgtgtgttgacgaaccagaagctaaagcgacctttacgcttgctcttaaatgggatgaacaagatggcgaaattgctcttgccaacatgcctgaaatcgaagttgataaagatggttaccaccattttgaagaaactgttcgtatgtctagttaccttgttgcatttgcctttggtgaattgcaatcaaagactgatcatactaaagacggcgttttagtaggtgtttatgcaactaaggctcacaagcctaaggaattggattttgcattagatattgctactcgtgcaattgaattttacgaagacttctaccaaactaagtacccacttccacaatcattgcaacttgcattgccagattttagtgccggtgcgatggaaaactggggacttataacttatcgtgaagcttacttgttgcttgatccagacaatactagtttggaaatgaagaagttggtagctacagttattactcacgaattggctcaccaatggtttggtgacttagtaaccatgaagtggtgggataacttatggcttaacgaaagttttgctaacatgatggaatacttgtcagttgatggcttggaaccagattggcacatttgggaaatgttccaaactaatgaagcttcttcagcattatcacgtgatgctacagatggtgttcaaccaattcaaatggaaattaacgatccagcagatattgattcagtatttgatggtgcgattgtttatgctaagggttcaagaatgttggtcatggttcgttcacttcttggcgatgaagctttgagaaagggtcttaagtactacttcgatcaccacaagtttggtaatgccacaggtgacgatctttgggatgcactttcaactgcaactgaccttaatattggtgaaattatgcattcatggctaaaacaaccaggttacccagtagttagtgcctttgttgataaagatggccatttgaagcttactcaaaagcaattcttcattggtgaaggtgaagataaggggagattatggcagattccattgaacgctaactttgatgctcctaagattatgtcagaaaaggaaattgatctaggcaactacaaggttcttcgtgaagaagcgggtcacccacttagacttaacgttggtaataattctcacttcatcgttgaatatgatgaaaccttacttaacgatattttggcagacgttaatgcacttgatccaatcgataagttgcaattattacaagaccttagacttttagcagaaggtaagcaaatttcttacgctgtaattgtgccacttcttactaagttcgcagattctaaatcaagtttggtaattaacgctttgtacactactgctaacaagcttcgtcaatttgttaaaccagaatcagaagaagaaaagaacctgaagaagctttacgatctcttatcaaagaagcaagttgctcgtttaggctgggaagttaagaagggcgaaagcgatgaagatgctcaaattcgtccatacgaattaagcgcaagtctctacgcagataatactgattcaattaaggcagctcaccaaatcttcactgaaaatgaagataacttggaagcaatgaacgctgatgttcgcccatacgttttgattaacgaagtaaagaattttggaagccataacttaattgccaagttaattaaggaataccaaagaactgctgatgcttcatacaaggtagaccttcgttctgctattaccagcacaattgataaggcagaagtagctacaattgtagaagatttcgaaaatgcagatattattaagccacaagaccttcgcggctggtaccgcggcttacttgctaaccatcatggtcaacaagctgcttgggactggatcagagaagattgggactggcttgataagactgttggtggtgacatggaatttgctacattcatcactgttactgctggtgtgttccacactcctgaaagacttaaggaattcaaggaattctttgaaccaaaggtaaatgttccacttcttagtcgtgaaattaagatggacactaaggttatcgaaagcaaggttaacttgatcgaagctgaaaaagatgctgtaaatagcgcaattgctaaggcgattgat

SEQ ID NO: 68 - protein, 844 aa, Lactobacillus acidophilus
MAVKRFYETFHPEHYDLRIDVNRKNKEINGTSTITGDVVENPVFINQKFMTIDSVKVEGKDVDFEVVEKDEAIKIETGVTGKAIIEIAYSAPLTDTMMGIYPSYYELEGKKKQIIGTQFETTFARQAFPCVDEPEAKATFTLALKWDEQDGEIALANMPEIEVDKDGYHHFEETVRMSSYLVAFAFGELQSKTDHTKDGVLVGVYATKAHKPKELDFALDIATRAIEFYEDFYQTKYPLPQSLQLALPDFSAGAMENWGLITYREAYLLLDPDNTSLEMKKLVATVITHELAHQWFGDLVTMKWWDNLWLNESFANMMEYLSVDGLEPDWHIWEMFQTNEASSALSRDATDGVQPIQMEINDPADIDSVFDGAIVYAKGSRMLVMVRSLLGDEALRKGLKYYFDHHKFGNATGDDLWDALSTATDLNIGEIMHSWLKQPGYPVVSAFVDKDGHLKLTQKQFFIGEGEDKGRLWQIPLNANFDAPKIMSEKEIDLGNYKVLREEAGHPLRLNVGNNSHFIVEYDETLLNDILADVNALDPIDKLQLLQDLRLLAEGKQISYAVIVPLLTKFADSKSSLVINALYTTANKLRQFVKPESEEEKNLKKLYDLLSKKQVARLGWEVKKGESDEDAQIRPYELSASLYADNTDSIKAAHQIFTENEDNLEAMNADVRPYVLINEVKNFGSHNLIAKLIKEYQRTADASYKVDLRSAITSTIDKAEVATIVEDFENADIIKPQDLRGWYRGLLANHHGQQAAWDWIREDWDWLDKTVGGDMEFATFITVTAGVFHTPERLKEFKEFFEPKVNVPLLSREIKMDTKVIESKVNLIEAEKDAVNSAIAKAID

SEQ ID NO: 69 - DNA, 630 bp, Lactobacillus acidophilus
  CDS (1)..(630): Signal peptidase I ORF# 1909
atgtctaaacaaaaagaagaaaatgaatcttggggcagatttgtccttgatattgtgattatttgggccgttttgatgggaatctttttcctgctctttcgttttgtattgagtaacgatactgtatctggcccatcaatgcagcctagttttgagaatggtcaacgtttaatttctgtgcgtcatgcacaaattaaacgtggcgaagtagtcattgttaaagcaccagatgaaccaggagctttatacattaagcgagttattggtatgcctggtgaaaagattgtcagcaagaacaatcaaatctatattaataacaaaaaattgtctcaaccatggttgactcaaggcaaaaagatgattgatgctggtagcgatacattctattcagctactcaaaactttacaatgaaatctcttgctcgatcacgccaattccagcaatattacactaagtcacaattgaattatattaataaatataatcgaattcctaaggaaacatattttgtgatgggtgatcatagaagtgtttcaaaagatagtcgttatattggaacgattaagcgtaagaatgttgtaggtgtggtaaaactaagatattggccacttaatgaatttaagatttat

SEQ ID NO: 70 - protein, 210 aa, Lactobacillus acidophilus
MSKQKEENESWGRFVLDIVIIWAVLMGIFFLLFRFVLSNDTVSGPSMQPSFENGQRLISVRHAQIKRGEVVIVKAPDEPGALYIKRVIGMPGEKIVSKNNQIYINNKKLSQPWLTQGKKMIDAGSDTFYSATQNFTMKSLARSRQFQQYYTKSQLNYINKYNRIPKETYFVMGDHRSVSKDSRYIGTIKRKNVVGVVKLRYWPLNEFKIY

SEQ ID NO: 71 - DNA, 903 bp, Lactobacillus acidophilus
  CDS (1)..(903): Prolyl aminopeptidase (EC 3.4.11.5)
ttggcaatggatcaaacaagattagtaactttagataatggttatcacctatttacacgaaaagtcaatgaaggacctattaaactgctttgcttacatggtggccctggcggaacacatgaaacttttgataattttaaagatggcttaaaagggcaaggcgttgaagtttattcatatgatcaattaggatcttactattctgatcaacctgattttactaaaaaagaaaataaatcattactttctatccctcgatatgtcgacgaagtcgaagaagtaagacaaaagttaggcttagataacttttacttgttgggacattcatggggtggacttcttgctcaagaatatgcttacaaatatggcaaacacctaaagggcctagttctaatgtcaatgattgataacttagatgaatatacagaaaatattaatcatgaacgtgaagaaactttttcacctgaacaagttgattacatgaaagaatgtgaaaaagctgagaactttactgaccctatgtatcagcaattagttgctcatctttattccctctttttaacaagacatcccacaggtacagctcatcctgtaaatactcacaataatgtgatttacaactatttccaaggaaataatgaatttgttatggtgggtgagcttaccaaatgggatttcagagagaaactagcaagtttgaagatgccaactttattaacctttggagaattcgatactatgccactttcagctgctcgcagaatgcatcaaacactaagtaattcacgcttaactttaactccggatggcggacattgtcataatactgataatccaaaagcattcttcacgtctttaactaagtttttacacgatgttgagaacaacacattcaagggagaa

SEQ ID NO: 72 - protein, 301 aa, Lactobacillus acidophilus
LAMDQTRLVTLDNGYHLFTRKVNEGPIKLLCLHGGPGGTHETFDNFKDGLKGQGVEVYSYDQLGSYYSDQPDFTKKENKSLLSIPRYVDEVEEVRQKLGLDNFYLLGHSWGGLLAQEYAYKYGKHLKGLVLMSMIDNLDEYTENINHEREETFSPEQVDYMKECEKAENFTDPMYQQLVAHLYSLFLTRHPTGTAHPVNTHNNVIYNYFQGNNEFVMVGELTKWDFREKLASLKMPTLLTFGEFDTMPLSAARRMHQTLSNSRLTLTPDGGHCHNTDNPKAFFTSLTKFLHDVENNTFKGE

SEQ ID NO: 73 - DNA, 1455 bp, Lactobacillus acidophilus
  CDS (1)..(1455): Unknown (PFAM: protease) ORF# 87
atggtagaaaataaatggctgcatgctagaaaaatggaagtaagaatgctgattattgaagcaatctatgtttttagcatgtttctttccttagttttttactttccactttttgtcattgaatttaaaattgcaattgcctttactttcctggtaatgattggagaattatttgaaattaagttcaaaaacgaagaaagcaaagacagaatagatattaaggaacatggtttgatgaaaccatgtttttttcataaggaggaaaagcgtgtgaaagcaaaaagttggaattggaatatgatactgaatattcagttaatcataaatattttgatagcaggatatttactggtaagagaaaacaagaacttagatattcaaattatctttggcattattctgttgtatataattattgctagattattcattaaaaatcagtacatagaaaagtttaatttggtactagaaataatctgcttgccgattttgttaacatattatttgaattggctagtcatttcattggtacactttttaccagcaataaaattagagattattaccatttatctagtggtgattttgctatatttgcttccgacatctgtggttgcttttggcaaaattcataatggatatttacgcattgcggcaagtatctatttgttcctagtttttttgtctagtatcaactcaagcttgtccgtaaatgttgattttattgataatttactgaaggtgaatgttgtttctggcatggcttttctaattttgactccatttttgttaagacagtggggattcaagtttcggatgaatgtatttcccagaaagcaggaaaattttcaattactagttttaattttactggtgctttttgctgcatggcttacattttttaatacttacgtatatatcgcgactgtgccagagcaattattctttaattgggatttgagtattttagctccaactcaatggacggtactcagaagtgctggtgctgcgatttttgaagaaactgaacgctatttaattttgattttactcttgtatattgcacgtaattccaggtttcaaattcagatagctattttcttcagcgctgtacaatttggtctgcttcatatgacccactttcttgatgcagatgcgaatgtatctagcattttctatgaagtactatacactttcggctatggttgttttttagctgttttgtacttgtatagtgggcaaatctggctatcaatgttgtcccactttacattggatttggtctcgtactcggtaggtaatggaggcgtcggatttttatcgctttatggcaacgttgaaggaatcggtgcagcgttagttttggcagttaacttattagttgtctttctgatgttgtggggaaaacgaaaaatagttatgcaaaataatgcgagaatattaattgaaagaatc

SEQ ID NO: 74 - protein, 485 aa, Lactobacillus acidophilus
MVENKWLHARKMEVRMLIIEAIYVFSMFLSLVFYFPLFVIEFKIAIAFTFLVMIGELFEIKFKNEESKDRIDIKEHGLMKPCFFHKEEKRVKAKSWNWNMILNIQLIINILIAGYLLVRENKNLDIQIIFGIILLYIIIARLFIKNQYIEKFNLVLEIICLPILLTYYLNWLVISLVHFLPAIKLEIITIYLVVILLYLLPTSVVAFGKIHNGYLRIAASIYLFLVFLSSINSSLSVNVDFIDNLLKVNVVSGMAFLILTPFLLRQWGFKFRMNVFPRKQENFQLLVLILLVLFAAWLTFFNTYVYIATVPEQLFFNWDLSILAPTQWTVLRSAGAAIFEETERYLILILLLYIARNSRFQIQIAIFFSAVQFGLLHMTHFLDADANVSSIFYEVLYTFGYGCFLAVLYLYSGQIWLSMLSHFTLDLVSYSVGNGGVGFLSLYGNVEGIGAALVLAVNLLVVFLMLWGKRKIVMQNNARILIERI

SEQ ID NO: 75 - DNA, 792 bp, Lactobacillus acidophilus
  CDS (1)..(792): plnI PRF# 553
atgcgcaaaaacacattatgttataggagaaataagatgattgaaaaacgaaatttcaagaaatcaattgctatctggatctgtttattattagtgtatacattggctggtctagtactgcgaccaatcaataatttaaccttacgcttagcgatccgttgttttattgctctagttattacaggattctgtttttattttatgcatggcagcaagctttattctaacgagcttaatttgcgacacattaaaatttataacactatttttattattattgttgctatcttctatttattttttcgcctgccaatttggattgaattatttactactcaaagaagcggattaatcaattctttactgattgcagtttgtgcaggattttgtgaagaagccttgtttagaggaatgttgtttaatatctgcgctaattatttgaaaaaacatcggtatatttggcttgaaacagctttagttacttcaattctttttggactaatgcactcagtcaatttgctttccagtgagccactaccctctgtaggtacacaagttttttacgcttttgccagcggattaatgtttgcatacctgcgtttaatgtctaaccatctttggccagctatcttggctcatgctgcctttgattttacaatcgtacctaaaaatgcggtatttgcaatcaacgctcaaggattatcactagtttacataatttttggtattcttaccgttatctatttattgttcatttggagcttcaacagattgtacaatgaaactaaagcc

SEQ ID NO: 76 - protein, 264 aa, Lactobacillus acidophilus
MRKNTLCYRRNKMIEKRNFKKSIAIWICLLLVYTLAGLVLRPINNLTLRLAIRCFIALVITGFCFYFMHGSKLYSNELNLRHIKIYNTIFIIIVAIFYLFFRLPIWIELFTTQRSGLINSLLIAVCAGFCEEALFRGMLFNICANYLKKHRYIWLETALVTSILFGLMHSVNLLSSEPLPSVGTQVFYAFASGLMFAYLRLMSNHLWPAILAHAAFDFTIVPKNAVFAINAQGLSLVYIIFGILTVIYLLFIWSFNRLYNETKA

SEQ ID NO: 77 - DNA, 858 bp, Lactobacillus acidophilus
  CDS (1)..(858): Serine protease ORF# 601
ttggaggaaaaaatgaaaactgggttagtgttagaaggcggtgcaatgcgtggattatttaccgctggtgtgatcgatgtcttaatggaaaacaagattaattttgatgtagcaattggagtttccgctggagctgcttttggcgttaatctgaaatccaaacaaattggccgagttctgcgttataatttacgttttgcaggtaaatcttattatgcaagttggaagtcatggcgtagatctggtaatttgtatgctgctaatttttgctatcatattttgccagataagttagatatttttgataaagaaacttttatggctaatccaatgcgattctgttgtgtagcgactgatgctgcaacgggagagcctgtttatcatgagttgtacgatgctgggtatgtagatttagagtggattagggcatcctcttcaattccattttttgctcatcctgttgctattggtggccattattattttgacggcggagtttctgattctattccatatgattttttgataaagaacggtgtttctaaaagggtagtaattacaacgcaacctaaagaatatcgtaaaaagcaaagtaagctatatccaattgaaaaaattgtactacgtgaatatcctgctgttttaaagaaattagctactagagcagaagattataatgcggttttagataagatggaagaagatgaaaatcaggggaatgcatttattattcgtccgccatatccgctagaaattggtactgttgaacaaaataaagaagagattaaacgggtatatgagatcggacgaaaaaaggcagaagaaattctgccagatttggttgaatatttgaaagac

SEQ ID NO: 78 - protein, 286 aa, Lactobacillus acidophilus
LEEKMKTGLVLEGGAMRGLFTAGVIDVLMENKINFDVAIGVSAGAAFGVNLKSKQIGRVLRYNLRFAGKSYYASWKSWRRSGNLYAANFCYHILPDKLDIFDKETFMANPMRFCCVATDAATGEPVYHELYDAGYVDLEWIRASSSIPFFAHPVAIGGHYYFDGGVSDSIPYDFLIKNGVSKRVVITTQPKEYRKKQSKLYPIEKIVLREYPAVLKKLATRAEDYNAVLDKMEEDENQGNAFIIRPPYPLEIGTVEQNKEEIKRVYEIGRKKAEEILPDLVEYLKD

SEQ ID NO: 79 - DNA, 1206 bp, Lactobacillus acidophilus
  CDS (1)..(1206): plnI ORF# 604
gtgaagcaaagaaaaatgaacttaaaaaagtgggattttggatttaggtatgaaactgccatcgttatcctagtttggtggggaatggcaatctttaatattagtaaaggaaaatcagctacagcaggattatgtattgcagctagtgttttgccagtacttgtctttgtgtttgatttactcaagcggcattcagacaaatggacagtggcagcaaattggctggcaattgtattaatgccagcaattttgtcgattacgtggtacatactttttagaaatattttgcagcatgtcatttttaaaatgttcattacgatcgtttttagtttaattttactggtgatggacttaccggttgcagttgtagcaattggacaattgagaaattggcttggacgattaattgcagtatgttatttcaacatggtacttttatcatctactgtaattgaattaaagccccagggaattaatgttttaattacttcaggcttaatggcagcaatcgctacctttttagctgcaatattaattgcaaaaaggtggagctttagttttaatcccgatttgaaatggcaggggtcaaacgtaactttaatttggttggtactattttgtcttattttcgccttctgggcagaattttgcggtcaaggaaatagtctaggagaaattttattaaaaccagatcttgctccgctaaaaccaacttgggtgtcattttgtagagcaatagaagcaggggtctttgaggaaactaaccgctatttaacgattttagctttgattgctggttttgcttatagtagatatcgggttcaaattgctttgattgtcagtgccatattctttggtttactacattttactaatttgggtggtcaagcttttgcggctacgctaaaccaagctgtctatgccgcagcactgggcttagttttcgcaattatgtatttatatactggtaaattatggctagccatgttgtatcacttcgggatcgattttcttaattatgcagttaatggtggagttaaagcacaggtttggtctggtacgcttagtgattgggtcagctcatttgtattagttctggtgccagtagctattgccgtctggatgatgacaggtaagagaaagcaagttatggatgaaaatattgatgaaaaattgaaaacgaatgaatggcaaataggacttagt

SEQ ID NO: 80 - protein, 402 aa, Lactobacillus acidophilus
VKQRKMNLKKWDFGFRYETAIVILVWWGMAIFNISKGKSATAGLCIAASVLPVLVFVFDLLKRHSDKWTVAANWLAIVLMPAILSITWYILFRNILQHVIFKMFITIVFSLILLVMDLPVAVVAIGQLRNWLGRLIAVCYFNMVLLSSTVIELKPQGINVLITSGLMAAIATFLAAILIAKRWSFSFNPDLKWQGSNVTLIWLVLFCLIFAFWAEFCGQGNSLGEILLKPDLAPLKPTWVSFCRAIEAGVFEETNRYLTILALIAGFAYSRYRVQIALIVSAIFFGLLHFTNLGGQAFAATLNQAVYAAALGLVFAIMYLYTGKLWLAMLYHFGIDFLNYAVNGGVKAQVWSGTLSDWVSSFVLVLVPVAIAVWMMTGKRKQVMDENIDEKLKTNEWQIGLS

SEQ ID NO: 81 - DNA, 2184 bp, Lactobacillus acidophilus
  CDS (1)..(2184): clpE protease ORF# 638
ttgctttgccaaaattgtcatcaacggcctgccgctattcacctttttacaaaggtaaatggtcaaagccgtgaaattgatttatgtcaacaatgttatcaagaattaagaaatcaacaaggaaatctagaaaatatgaacaacaataacgaattttttggcgactttgatgatttatttaacgcattaaacggaaataacaacaacgccgcaaataacaataataatatgaaaaataacgacccaagaatgcaaatgggtggtggaaatggtggtcaaggtggtagaagcttacttgatcaatatggtactgatttaactgctcttgctaaaaaaggtaaaatcgatccagttatcggtcgtgataaagaaatcgctcgcgtaattgaaattttaaacagaaggactaagaataatccagttttaattggtgaagccggtgttggtaagacagctgtagttgaaggccttgctcaagaaattgtagatggttctgttccagctaaacttcagaataaacgtattatttcattaaatgttgtatcacttgttcaaggtactggcattcgtggtcaatttgaacaaagaatggaacaattgattagagaattacaacaaaatgatgatatcatcctctttattgatgaaattcatgaaattgtaggcgccggaaatgccgaaggcggtatggacgcaggtaatattatcaaacctgctttagctcgtggtgaactccaattagttggtgctactactattaaagaatatcgtgatattgaaaaagattcagctttagcacgtagattccaaccagttgaagtaaaagagccttcaattgatgaaacgattcgcattttgaagggaatccaacaacgttatgaagactatcatcatgttcaatactccgatgattccattgagtctgctgttaaattatcagctagatacattcaagatagattcttacctgacaaggctattgatcttttagatgaagccggttcaagaatgaatttaactattccttatattgataaaggaaaaatgcaagaacgtattaacgctgcagaacaattaaaagaggaatctttaaagaacgaagactacgaaaaagcagcttattatcgtgatcaaatcgaaaaatatgaaaagatgaaggatcaaaaagttgatcctgataaatcaccaattattaccgataagattatgaacaagattgtcgaagaaaagacaggaattcctgttggtgatattcaaaagcaagaagaaaatcaattgcaaaacttggctagtgatttaaagtctaatgttattggtcaagacaaggcagtcgaaaaagttgctcgagctattcgacgtaacagaatcggtttcaataagtcaggacgtccaattggttccttcctatttgttgggccaaccggtgttggtaagaccgaattagctaaacaactagccaagcaaatgtttggttcagaagatgccatgattcgtttcgatatgtcagaatacatggaacaatattctgtctccaaattaatcggctctgctccaggttacgtaggttatgaagaagctggtcaattaactgaacaagttcgccataatccatatagcttgattctacttgatgaaattgaaaaagctcatccagatgttttgaatcttttcttacaaatcttagacgacggccgcttaactgactctcaaggtagaaccgtttcatttaaggatactattattattatgacttctaacgcaggccaaggtatcaagaatgccagcgttggttttactgctgaaaatgatgacgaatctagcgaatcagcaagaaataatatgagtcaattctttaaaccagaatttttaaatcgtctagatgatgtaattgaattcaatgaattgactaagccagacttattggaaattgtagatcttatgcttcaaaacactaacaatatggttaaggatcaaggcttacatattgacgtaacctcagctgctaaaaataagcttgttgaagaaggctttaatcctgctttaggtgcccgtcctcttcgtcgtacaattcaagaagaaattgaagataaagttgcagattacaagcttgaccatactgaaagtaaaaacttaaaggctgacgtaattaatgatcaaatcgtaatcagtgacgaaacagctcaa

SEQ ID NO: 82 - protein, 728 aa, Lactobacillus acidophilus
LLCQNCHQRPAAIHLFTKVNGQSREIDLCQQCYQELRNQQGNLENMNNNNEFFGDFDDLFNALNGNNNNAANNNNNMKNNDPRMQMGGGNGGQGGRSLLDQYGTDLTALAKKGKIDPVIGRDKEIARVIEILNRRTKNNPVLIGEAGVGKTAVVEGLAQEIVDGSVPAKLQNKRIISLNVVSLVQGTGIRGQFEQRMEQLIRELQQNDDIILFIDEIHEIVGAGNAEGGMDAGNIIKPALARGELQLVGATTIKEYRDIEKDSALARRFQPVEVKEPSIDETIRILKGIQQRYEDYHHVQYSDDSIESAVKLSARYIQDRFLPDKAIDLLDEAGSRMNLTIPYIDKGKMQERINAAEQLKEESLKNEDYEKAAYYRDQIEKYEKMKDQKVDPDKSPIITDKIMNKIVEEKTGIPVGDIQKQEENQLQNLASDLKSNVIGQDKAVEKVARAIRRNRIGFNKSGRPIGSFLFVGPTGVGKTELAKQLAKQMFGSEDAMIRFDMSEYMEQYSVSKLIGSAPGYVGYEEAGQLTEQVRHNPYSLILLDEIEKAHPDVLNLFLQILDDGRLTDSQGRTVSFKDTIIIMTSNAGQGIKNASVGFTAENDDESSESARNNMSQFFKPEFLNRLDDVIEFNELTKPDLLEIVDLMLQNTNNMVKDQGLHIDVTSAAKNKLVEEGFNPALGARPLRRTIQEEIEDKVADYKLDHTESKNLKADVINDQIVISDETAQ

SEQ ID NO: 83 - DNA, 1230 bp, Lactobacillus acidophilus
  CDS (1)..(1230): Hypothetical protease ORF# 660
atgaaggtaattcaaacgatgctaacaactaatataacaattagaaaaaataaaaaatttacaacagccggaataggctgttttttgcgtttaccgttaactaatcataatttagcttttgctagtttactttcgcgattgcaaatgaatactagtttgtcatatccaacaattgctgctcaacaaagaaagttagcccaattatatgatttgcagcttgatattatgccgcaactttttggcaaccaaattattttgatgtattatgctaattttgttgaaccgattgaagtattggatccagattatacttatgaagaaataatccaaactattagccaaattatcagatttccagcatatgataataatttattcgattatgctaaaagacaacttgaagatgaatatcgtgaaattatggttcaaccttcaaattatgctctcgatcgcttttttaaattatggtatgaagatcaaccagaatatgctgaaaactttatggggccaattgatgaaataaaaaatactacgattgttgagatgcgtgattttattgaaaatttgcgtgatataccaatggcggtaattggcatgggacgagacaatcaattaatgactaaaatactcagaaatatttttaaaggggctggaattattaaaaaattccaagttagtgatttagttattccagctaaaagaaaattaattgaaaaagttgatgagcaagacaatattcaagctcaattattgatgggatttggttttaaacagagaattagttatcaagaacaagttgttggtttgcttttagaacaatatttagctggtgatcagtcttcaaaattatttagtcagattagagaagagttaggtgcggcttatgatgttcaagcaagtgactttgctaataattctctctttttaattaatgctggaattgatcctcaaaaagtagaaccagccaaaagaattattcttaatgaaatgcaaaaattaatggatggtaatatagatgaagagctatttagaaaatccaaaaaggctgtatatcgaaacactaggattgggttagacaatcaaaattggcaattaggacaggccttgcgtgccgaattattaccagattatttagattttgatagagaagctgctataaaaaaagcaacgccacatcaattaattaattttgttcaaaatttattctttaatgaaagttatattttaaaa

SEQ ID NO: 84 - protein, 410 aa, Lactobacillus acidophilus
MKVIQTMLTTNITIRKNKKFTTAGIGCFLRLPLTNHNLAFASLLSRLQMNTSLSYPTIAAQQRKLAQLYDLQLDIMPQLFGNQIILMYYANFVEPIEVLDPDYTYEEIIQTISQIIRFPAYDNNLFDYAKRQLEDEYREIMVQPSNYALDRFFKLWYEDQPEYAENFMGPIDEIKNTTIVEMRDFIENLRDIPMAVIGMGRDNQLMTKILRNIFKGAGIIKKFQVSDLVIPAKRKLIEKVDEQDNIQAQLLMGFGFKQRISYQEQVVGLLLEQYLAGDQSSKLFSQIREELGAAYDVQASDFANNSLFLINAGIDPQKVEPAKRIILNEMQKLMDGNIDEELFRKSKKAVYRNTRIGLDNQNWQLGQALRAELLPDYLDFDREAAIKKATPHQLINFVQNLFFNESYILK

SEQ ID NO: 85 - DNA, 1251 bp, Lactobacillus acidophilus
  CDS (1)..(1251): Protease ORF# 661
atgattacacctaaaattataaaaagagaatataaatctggctttaaagcagaagttatcttaaaaccgcatttttatcagcgtttttttggtattattatcgactttggtagtagtgatgcacaaaaaatagctgggtcagcccattttttagaacataaattatttgctaaaaaagatggcgatatttcacataagtttgaagaaattggtgcggatgttaatgcatttacatcatttaatgaaactatgttttattgcagtggtattgaccatacgcctaaaatgctcgatttgttgtttgaattagttggaaaaccatactttactaagcaaaatattgctcaagaagccccaattattcaacaagaattggctatgtataaaaatgatccgatttggagtataaataatgcgattatgactgcaatgtttgatcattcaaatttaggtactgaagttgtgggaacagaaaaatcgattaatgagattactgttcaaaacttaactaaggcatataagaataactatataccaagtaaaatgcagtttgtagcatgcggtgatttttcagataatcaagtccaaacaattttacgtacagttggtaagctgcaagaaaagtactttcaaaatagaaaagcgactccaactaaaattgaaatgccaattggaaatttaaaggatcaagttattcctactaaaagtggttctaatgtttttggattgggtattcgttttaaaaattttaagaaagtattatcaagctttgatttgactcaaattctgttagaaataatgttagaatcaaaactaagtgtaatgggcccatggtttgaaaggatgcgaaaaaataagttattaactaatccacttcaaatttcggttaattacactagacagggtgattttgcaaccatttttggtactagtccgcaaggacaggaagtaattaatgaaataaagcatgttttaactaagccattagttaaaaattctgaacaatatcgctttatcgaagaaaattttgaattgcaaaaaagagaatggcatgcacgcactgtcagaacaattaataatctttcatcatatgctattgaaatggtagaagaaaatttagatcatgaagacttagatttaaatttaaagaaattacaagcaatgggttttgaagaattctatcaaacttgtcaattaattatgaaagatagtgcaatttgttccgcttatttagatcctaacagggaggga

SEQ ID NO: 86 - protein, 417 aa, Lactobacillus acidophilus
MITPKIIKREYKSGFKAEVILKPHFYQRFFGIIIDFGSSDAQKIAGSAHFLEHKLFAKKDGDISHKFEEIGADVNAFTSFNETMFYCSGIDHTPKMLDLLFELVGKPYFTKQNIAQEAPIIQQELAMYKNDPIWSINNAIMTAMFDHSNLGTEVVGTEKSINEITVQNLTKAYKNNYIPSKMQFVACGDFSDNQVQTILRTVGKLQEKYFQNRKATPTKIEMPIGNLKDQVIPTKSGSNVFGLGIRFKNFKKVLSSFDLTQILLEIMLESKLSVMGPWFERMRKNKLLTNPLQISVNYTRQGDFATIFGTSPQGQEVINEIKHVLTKPLVKNSEQYRFIEENFELQKREWHARTVRTINNLSSYAIEMVEENLDHEDLDLNLKKLQAMGFEEFYQTCQLIMKDSAICSAYLDPNREG

SEQ ID NO: 87 - DNA, 591 bp, Lactobacillus acidophilus
  CDS (1)..(591): Hypothetical PFAM protease ORF# 1808
gtgctactgctccttttctcagcttatttcccattttttaatgtgtttttggggatagcacaaacaccggtacaaatctttaactgggattttagtacttttgaagtaacgttgactggatttctttcagcagtagaagccggaatcatggaagaaacgcaacgttgtttagatattgttgtacttttatttgtctttcgtaattttaaaggaaaagtagtgtgggctaccgtaatttcttcactattatttagcttggatcatttgactaatttgggttcaacgcaatttggcgttctttataatttgacaaaagttgaacagcaaatgatctatacctttggatttggcatgttagctgcagttttgtacttatatactggtaaattatggttaagcatgttggttcactttggcttagatttcattgtctttagtgaaacgccattaactgtgtcgatatctccattttttgataattgggcttgtgcttttattgtaatggcagcatcatccttggtagccatcttcatgttattaggaaaaagatgtaagtttatggatgataatgcagatagaattatgaaaatg

SEQ ID NO: 88 - protein, 197 aa, Lactobacillus acidophilus
VLLLLFSAYFPFFNVFLGIAQTPVQIFNWDFSTFEVTLTGFLSAVEAGIMEETQRCLDIVVLLFVFRNFKGKVVWATVISSLLFSLDHLTNLGSTQFGVLYNLTKVEQQMIYTFGFGMLAAVLYLYTGKLWLSMLVHFGLDFIVFSETPLTVSISPFFDNWACAFIVMAASSLVAIFMLLGKRCKFMDDNADRIMKM

SEQ ID NO: 89 - DNA, 1194 bp, Lactobacillus acidophilus
  CDS (1)..(1194): Hypothetical PFAM protease ORF# 1810
atgaaaaatagaatttatcaattgattttaaaaattcaattgatagtaggaatactgctcatgctttgccttaatctgaatgtggtacatacatttaagatgcctaaactagtatatccaactattctatgtgcattagtagtaatatttgttttgactctctttgaaaataaaaaccgttatatacaggcagcggcaaaatggcttggcgttctagcattaccatatgcatctaatttcttagtttatactggaatttcagttcttaatattgcatttccaagctatgcaatgtttttctcaatcataggctgtattcttttacttgtagtaaatattccctgggtaatggttgatttgccgatagtaaagaatggttttctccgtgtgctaagtatcgctcttattgatatgagctttacatttaatgccaatgactttattaatttgccggagtcgcttcattttcttgtatacgatgccgtgatagttgccatagaaatctttgttttaggcttttttattacgaaggcatggggcttgaaattcagttggaatttgaagtttgttaaaacaagtaattttcaattaggatcctggattgtattaattctggtaatgatctggcttattttctttaatacgtatttaaatcttgtaaataactgggcagaattgcttgctttttggaactggaatagctttgaaatttcatatcactttactgcagatatagtgagttttgcagctagagcgggtatttatgaggaaatgtttcgcggactagaaataattgttttgctttatgctatgcgtaacttcaaagacagaataatggtggctgtagtaatatcagctattttgttcagtttagggcatttgagtaatctgggtactattaccaatggtactttttattctgctgatatgatggcgcagcaacttatatatgcgtttggtctgggcttggcgtttggtgtactgtatttgtatactggaaaattatggctagggatgctgatccactttttgtatgatttagagactttgagtactgatgtcacaacaggcttgtttacaggttggccggcttcaattatgttgttaatcattggcgtagcgatttttgtctggatgttaacaggtaagagacgtaagttcatggaagataatgtagatcgaattgttggcgga

SEQ ID NO: 90 - protein, 398 aa, Lactobacillus acidophilus
MKNRIYQLILKIQLIVGILLMLCLNLNVVHTFKMPKLVYPTILCALVVIFVLTLFENKNRYIQAAAKWLGVLALPYASNFLVYTGISVLNIAFPSYAMFFSIIGCILLLVVNIPWVMVDLPIVKNGFLRVLSIALIDMSFTFNANDFINLPESLHFLVYDAVIVAIEIFVLGFFITKAWGLKFSWNLKFVKTSNFQLGSWIVLILVMIWLIFFNTYLNLVNNWAELLAFWNWNSFEISYHFTADIVSFAARAGIYEEMFRGLEIIVLLYAMRNFKDRIMVAVVISAILFSLGHLSNLGTITNGTFYSADMMAQQLIYAFGLGLAFGVLYLYTGKLWLGMLIHFLYDLETLSTDVTTGLFTGWPASIMLLIIGVAIFVWMLTGKRRKFMEDNVDRIVGG

SEQ ID NO: 91 - DNA, 651 bp, Lactobacillus acidophilus
  CDS (1)..(651): Hypothetical PFAM protease ORF# 1937
atgagaaaattttggcattacctgggaaatattgcagggataattgtcgcattaattttatatagtaggcttgagatattctattttgctccgcaaaggatacatttaggtaatcttcgtgttatagtaactgctttagtaactgtcgcaattttatttgtgattttttatttatatcgaagtcagttaagagaaagaaattattggggatttaatgagagtcctcactgggatatgagaagaattggaatagctgcgattggttttgtattaattacgatcggctcaattgtaatgttaaatatagtgggtggcggtgtttccgaaaatcagcaggctttaaatagaatccagcaacagaatactggaatgtttaagattctggtagtattcattgcaccgttttgcgaagaaacaatttttagagggatgtttttcaatatcttctttactaaacctacgcgtttgaataagtggctgggaatagttacaagtggctttttgtttggctacatgcatgatccgatgttaagcagatttatttttgtatattgggtgttggggatagtcttagcctgggtatatacgacaactaaggacttgcgctattcgatgctggtacacatgtgttataacgcattaggttttatt

SEQ ID NO: 92 - protein, 217 aa, Lactobacillus acidophilus
MRKFWHYLGNIAGIIVALILYSRLEIFYFAPQRIHLGNLRVIVTALVTVAILFVIFYLYRSQLRERNYWGFNESPHWDMRRIGIAAIGFVLITIGSIVMLNIVGGGVSENQQALNRIQQQNTGMFKILVVFIAPFCEETIFRGMFFNIFFTKPTRLNKWLGIVTSGFLFGYMHDPMLSRFIFVYWVLGIVLAWVYTTTKDLRYSMLVHMCYNALGFI

SEQ ID NO: 93 - DNA, 540 bp, Lactobacillus acidophilus
  CDS (1)..(540): Cell envelope-associated protease ORF# 1235
atgaaaatagcagatattattatacggggggtaggaactatgttaaaaaagaaaataatctatcttgcaggagtagcattgttcacagctggattaggggtagcagccaatactcatataacagaagctgctgttgctaatcctattaagcaaggaaaaaaattaagtttgactagaagtacatacgtctataataaagatggtgttagagttggacgcttaaagaaagggaatctttgcaaagtttatatcattaaagtgattaatgggaatagttatgttaaggttggcaagaatagatttgtaaaacaagaggcatttttaccatatgtaaaatctacggctaaggtagagaatcaaattaaaaaatcttcatttgtttatgatgaaaatggtgaaaaaataccaggcaaatttgtcaagcgtggggaaaaagtaaactatttaggtcataaagaaattaatgaaaagccatttatcaaaattggtgatggcgaatatgttaaagcttttaatgttttaactattatgattaataac

SEQ ID NO: 94 - protein, 180 aa, Lactobacillus acidophilus
MKIADIIIRGVGTMLKKKIIYLAGVALFTAGLGVAANTHITEAAVANPIKQGKKLSLTRSTYVYNKDGVRVGRLKKGNLCKVYIIKVINGNSYVKVGKNRFVKQEAFLPYVKSTAKVENQIKKSSFVYDENGEKIPGKFVKRGEKVNYLGHKEINEKPFIKIGDGEYVKAFNVLTIMINN

SEQ ID NO: 95 - DNA, 198 bp, Lactobacillus acidophilus
  CDS (1)..(198): Cell envelope protease ORF# 1378
atgagaagagacttacataatttagacgtaggggacgttaaagaaaaacaacgtttttcaattcgcaagttaactgtaggtactgctagtgtattgctgggtactacattcttgtttggtgcaggtcagactgcttacgctgatactactgcttcaggtgctattactagtgaagattcccaaaaccaaattgggggg

SEQ ID NO: 96 - protein, 66 aa, Lactobacillus acidophilus
MRRDLHNLDVGDVKEKQRFSIRKLTVGTASVLLGTTFLFGAGQTAYADTTASGAITSEDSQNQIGG

SEQ ID NO: 97 - DNA, 1398 bp, Lactobacillus acidophilus
  CDS (1)..(1398): Cytosol non-specific dipeptidase (EC3.4.13.18) ORF#35
atgccatgtacaacaattttagccggtaaaaaggctactgcagacggttcaaccttagttgccagaaacgaagactatggtcacgcatttaatcccaagcgttttatcgttgtaacgccagacaagcaacctaaggattatcaatctgtaacttctaaatgcaaggtggatttgccagataatccaatgcgttacaccgctgtgcctgaacttgaatcaactatcaaaaaagtaggctggtggggtgaagcaggtattaacgaagcaaacgttgctatgtctgctactgaaactagcactactaattcacgtgtattaggtatcgatccaatgaataaaaagggtatcggtgaagaagactttgttactatcgttttgccttacattcgttctgctcgtgaaggtgtgaagctattaggtaaatacttagaaaaatacggtacctacgaatcaaatggtgttgccttctcggataaagatgaagtttggtacatggaaactattggtggtcgtcactgggccgctattaaggtgccagatgatagttatatcgttgcaccgaactggtttagcattaccaattttgactttaatagtgacgatacaatggcttcagatgatttggaaaagatgattcaagataatcacatggatattgatcatagtggtaatccatataatttgcgtcatatcttcggcagtcatgacgattcagattatgaatacaatattccacgtcaatggtatattcaaaagctgttcaatccgagcgatgttcatgaacctgatgatccagatttgccatttgctaaaaagccagagcatttacttactattgaagacttaaagtatgctttgtcatcacactatcaacacactaaatacgatccatacggcttagagggcacagatgcggatcgccacgcttttcgtccaattggcttacaacgtaatcaagaattatctattttacaaattagaaatgatgtcccagccaaaattgctggtgtgcaatggattgcctttggacctaatacttttaatggtattgcaccatactataccaacgttcttgatacgccggaaacatatcgtgatactaaagagcatttcaatattcaaaacatgtattggttaactcatgcaattactacaattgctgatgagcacccattccgctacagtgcttcgattgaagcaatgaagcaaagcactttagctgctggtcgtcatgttttgcttgaaaccgatcaagaagttcaagaacttgccggtgaagaattacaaagaaaacttcaacaggctaatgataaaactgctaaagctgcttatgataccgcaatgaaatgctttggcgaatgtgttgagactggatcacttaagatcagattgaattat

SEQ ID NO: 98 - protein, 466 aa, Lactobacillus acidophilus
MPCTTILAGKKATADGSTLVARNEDYGHAFNPKRFIVVTPDKQPKDYQSVTSKCKVDLPDNPMRYTAVPELESTIKKVGWWGEAGINEANVAMSATETSTTNSRVLGIDPMNKKGIGEEDFVTIVLPYIRSAREGVKLLGKYLEKYGTYESNGVAFSDKDEVWYMETIGGRHWAAIKVPDDSYIVAPNWFSITNFDFNSDDTMASDDLEKMIQDNHMDIDHSGNPYNLRHIFGSHDDSDYEYNIPRQWYIQKLFNPSDVHEPDDPDLPFAKKPEHLLTIEDLKYALSSHYQHTKYDPYGLEGTDADRHAFRPIGLQRNQELSILQIRNDVPAKIAGVQWIAFGPNTFNGIAPYYTNVLDTPETYRDTKEHFNIQNMYWLTHAITTIADEHPFRYSASIEAMKQSTLAAGRHVLLETDQEVQELAGEELQRKLQQANDKTAKAAYDTAMKCFGECVETGSLKIRLNY

SEQ ID NO: 99 - DNA, 894 bp, Lactobacillus acidophilus
  CDS (1)..(894): htpX heat shock protease ORF#96
atgttgtaccaacaaattgcccgtaacaagcgtaaaactgcgctaattatggttctttttgtggtaatcttgaccttagttggtgctggactgggctatctttttagcaatagtccatggacgggaataatcattgcattagctggtagcttaatctatctattaattatgtggcaaaacccagctaacatgattatgagtctcaatcatgctcaggaaattcaagaagctgataaccctgagttgtggcatattgtagaagatatggcaatggtagctcgtgtaccaatgccacgcgtttttattattcctgatcctagcccgaatgcttttgcaacggggcgtgatcctgaacacagcgctgttgccgtaacgcaaggaattcttgaattaatgaatcgagaagagcttgaaggcgttctgggtcatgaattatcacacgtacgtaattacgatattttattatcaacaatcggtgtagttttggtgggtgttatttcctttatttctggaatagcttctcgctatatttggtttttcggtggtaatcgtcgagacgatgaagatcgagacaccaatgcatttgaaataatttttaaagtcatcgctattgtctttgtattaattttaggtcctatttctgcatccctcgcacaaatggccctatcacgtaatcgagaatatttagctgatgcttcttctgttgaattaacccgtaatccacaaggcttaatctccgcattaagaaagattgaaggcagtcagcctatgcgtcaagcagatcgtagtagtgccgggttatatattgagaacccatttcacaatcacggtctatctcacttatttgacacacatccaccgacagaagatagaatcaaacgattagaacacatg

SEQ ID NO: 100 - protein, 298 aa, Lactobacillus acidophilus
MLYQQIARNKRKTALIMVLFVVILTLVGAGLGYLFSNSPWTGIIIALAGSLIYLLIMWQNPANMIMSLNHAQEIQEADNPELWHIVEDMAMVARVPMPRVFIIPDPSPNAFATGRDPEHSAVAVTQGILELMNREELEGVLGHELSHVRNYDILLSTIGVVLVGVISFISGIASRYIWFFGGNRRDDEDRDTNAFEIIFKVIAIVFVLILGPISASLAQMALSRNREYLADASSVELTRNPQGLISALRKIEGSQPMRQADRSSAGLYIENPFHNHGLSHLFDTHPPTEDRIKRLEHM

SEQ ID NO: 101 - DNA, 1080 bp, Lactobacillus acidophilus
  CDS (1)..(1080): Aminopeptidase M42 family ORF#569
atggaaaaagcacaagaaattgagatgcttaaagatttttcagatgctaatgctacatctggctttgaagaagaattcgttaaactttttattagctacgcagaaaaaactgccaatattgagactgacgggatgctgaatgtatatgcagcaaagaaggaaaataaaggcaatcgcccagtaattcaacttgatgcacactcagatgctgttggttttattactcaagctgttcgtccaaatggtttaattaaatttgtgccacttggtggttgggtaaaatacaacattcctgctctaaaagtgaaggtgagaaatcgtgatggtgaatatatccctggcgttgtagctactaaaccaccacattttatgactgttgctgaaagaaataatgtccctgatgtagcagatatgtcaattgatgttggttcaagtagccgcgaagaaaccattaatgattataagatcgatacgggctgtccaatctttgtcgatgttaagtgtgaatatcatgaaaaatcagggttattctttggtaaagacttcgatgatcgtttcggtgctggagcaatgattgatgttttggataatttaaaggatgaagaaactaactttgatgttgtggcagccttgtctagtcaagaggaagtagggcttcgcggagcttacgtaactgctagaaaagttaagccagatctatgtattgtgcttgaaagctgtccagcagatgatacttttactccggactggctttctcaaactggtttaaagcggggaccaatgttacgtgatatggatactactttcttgccaaatcctaagttccaacaatatgcttgcgacctagctgacaagaacaacattccatacactcgttcagttagaaccggtggtggacaagatggtgccgcaatttactacgaaaacggtgcaccaactattgttatcggtatcccagttcgttatgaacactcaccatattgcttcagtagctataaggacttcaaggcttctgtagatttggctactgcaattatccgtgatattacccaggaaaagttggatagtttcaagaagttt

SEQ ID NO: 102 - protein, 360 aa, Lactobacillus acidophilus
MEKAQEIEMLKDFSDANATSGFEEEFVKLFISYAEKTANIETDGMLNVYAAKKENKGNRPVIQLDAHSDAVGFITQAVRPNGLIKFVPLGGWVKYNIPALKVKVRNRDGEYIPGVVATKPPHFMTVAERNNVPDVADMSIDVGSSSREETINDYKIDTGCPIFVDVKCEYHEKSGLFFGKDFDDRFGAGAMIDVLDNLKDEETNFDVVAALSSQEEVGLRGAYVTARKVKPDLCIVLESCPADDTFTPDWLSQTGLKRGPMLRDMDTTFLPNPKFQQYACDLADKNNIPYTRSVRTGGGQDGAAIYYENGAPTIVIGIPVRYEHSPYCFSSYKDFKASVDLATAIIRDITQEKLDSFKKF

SEQ ID NO: 103 - DNA, 1149 bp, Lactobacillus acidophilus
  CDS (1)..(1149): Amino acid amidohydrolase (EC3.5.-.-) ORF# 853
atgacagttttaagtgaaaaagaattaattcaaattcggcggcatttacatgaaattcctgaattagctctccaagaaaaagaaacgcatgattatttactaaaggtaattaaaaatttaaaacaagatcatttaactattgtagtgcctaagacattaccaactgcaatattaggtttagttaaaggaattaatcctaaaaaaacaatcggctatagaactgatattgatgcattacctgtacaagaaaagactggcttaccttttacttcaaaacattctggaataatgcatgcctgcggacatgatattcatatgaccgtagctttaggcttattaagctattttagtgaaaatcaacctaaagataatttgctatttttctttcaaccagctgaagaaagtgagagtggaggaaaacaggcatacgaaaaaggcttatttcagggaaaatttaaaccagatgaattttatgggttgcatgataatccagaactacctgctggtagtattggctgtagaatgggaaccttatttgctggaacaactgaaataaatattgatgtaattggtaaaagcggccatgctgcttttccgcaaaatgctaatgatacagttgtagcggccgcaaatttaattatgcaaattcaaactatcatttcacgaagtattgatccaattcaaagtggtgtcattactttgggtaaggttaatgcaggagttattagaaatgtaattgcaggtcatactagaattgagggaactattcgtgggttaactcaaaaaatgattctacaaatagatagacgtttgcaagatgtatgtgatggaattgcacatagctataatgtagaagtaaatttggaattaaatcaaggtggctattggccagtagaaaatgatcctaagataactaaaaatttcatttcttatatgaagaaaaatcctaaggttaactttatagaaacagagcctaaaatgacaggagaagattttggctttttgctagcgaagttcccaggaacaatgttttggttaggagttggtgatccaagttcacaattacattcatctacacttaatccggatgaaaaaagtattcaaagtggaattgatgcaattaaaggatttttaattgatagaatgggg

SEQ ID NO: 104 - protein, 383 aa, Lactobacillus acidophilus
MTVLSEKELIQIRRHLHEIPELALQEKETHDYLLKVIKNLKQDHLTIVVPKTLPTAILGLVKGINPKKTIGYRTDIDALPVQEKTGLPFTSKHSGIMHACGHDIHMTVALGLLSYFSENQPKDNLLFFFQPAEESESGGKQAYEKGLFQGKFKPDEFYGLHDNPELPAGSIGCRMGTLFAGTTEINIDVIGKSGHAAFPQNANDTVVAAANLIMQIQTIISRSIDPIQSGVITLGKVNAGVIRNVIAGHTRIEGTIRGLTQKMILQIDRRLQDVCDGIAHSYNVEVNLELNQGGYWPVENDPKITKNFISYMKKNPKVNFIETEPKMTGEDFGFLLAKFPGTMFWLGVGDPSSQLHSSTLNPDEKSIQSGIDAIKGFLIDRMG

SEQ ID NO: 105 - DNA, 540 bp, Lactobacillus acidophilus
  CDS (1)..(540): Consensus hypothetical protein ORF#1661
atgaaagctatcaacttaaagaaaattataattgctagtgcagcattaatcggcctaggcgctgctgctatcactactattaatcaagcagaacctactactgttcaagcagctaccggcaaaattaaagtttctcaaagttctgcagtaaagaaattccaagctaaatataacgctaaaatcaaatctattaatttagaaaaagaaaatggtcgctatgtttatgaaattgaaggatttagctcaactagagaatacgaaatgaaaatcaatgcttctagtggcaagactatttcttctcattctgaaaaattagaagccggttataaaaaagcagctttgaatttaaataagactatttctcgttcaactgccacaaaaattgctcagaaacgtgtttctggtagcaaagctatcgaatggaaccttgaacgtgaaaactctagaagcgtatgggaagtaaccgttactaaaaatggtaaaaagagcgacgtgaaaatcaatgctttaactaaaaagattattagcgtcgaacgtgac

SEQ ID NO: 106 - protein, 180 aa, Lactobacillus acidophilus
MKAINLKKIIIASAALIGLGAAAITTINQAEPTTVQAATGKIKVSQSSAVKKFQAKYNAKIKSINLEKENGRYVYEIEGFSSTREYEMKINASSGKTISSHSEKLEAGYKKAALNLNKTISRSTATKIAQKRVSGSKAIEWNLERENSRSVWEVTVTKNGKKSDVKINALTKKIISVERD

SEQ ID NO: 107 - DNA, 606 bp, Lactobacillus acidophilus
  CDS (1)..(606): Consensus hypothetical protein ORF# 1662
atgaaactgaaattagctagtttaaccttattatccgtagcattaattgctactgcttgttctaataacgataacagtacaacacaaagtagtcggactattgaaaattctaaaaaaagtacagttactgaaaaaagaagttctgttgcttcaaaccaagtacaatcaagcgttaataaaattaagctaagccaacaagaagctatcgataaatttcataaccaatttaacaataaaaaaatccatagtattgatttaaaacttgaaggcagccaatacatctacgaaattgaaggtttcgacactacccataaatattctgccgagattaatgccgaaactggtcatgccagcagtgttcattcagagaaattagaacatgatgatcaagatgatcaacaagaattaaatcttaacggtgtaatcagccgtgatgaagctagtactattgctgaagagcacgctaaaggtacaagtcgtgaatggaatcttgaacaagaacatggtaaaacttactggaatgtagaagtaggtgaaagataccatagttctgaagttaaaattgatgctcatagtaaaaaagtaatttcagttgaaaatgatgac

SEQ ID NO: 108 - protein, 202 aa, Lactobacillus acidophilus
MKLKLASLTLLSVALIATACSNNDNSTTQSSRTIENSKKSTVTEKRSSVASNQVQSSVNKIKLSQQEAIDKFHNQFNNKKIHSIDLKLEGSQYIYEIEGFDTTHKYSAEINAETGHASSVHSEKLEHDDQDDQQELNLNGVISRDEASTIAEEHAKGTSREWNLEQEHGKTYWNVEVGERYHSSEVKIDAHSKKVISVENDD

SEQ ID NO: 109 - DNA, 579 bp, Lactobacillus acidophilus
  CDS (1)..(579): Hypothetical ORF# 1667
atgaaaagatttctgacattcattttaagtatttttgccggtattgctattggaattgctatttctcatgcaaatcaagagacccgaaagacaagcaacgttactgttcatgtcggagattttttaaataaaacacaggcagttagttattcaactgataaattgccaacgattagagttaatcaagctagtgcaattcgcaaatttaaatcgttatactctaacgcagtgataaaatctatttcattaactttaaataaagatatatatgtctataacatcataggctttgatgatcgaaaagactgtatgattcaagtcgatgcaactaataataaaatcataggtcaatcaactcaagtcttgaactatgattttgataaagaatcctatttaaatttgaataaaacaatttcacgtagtgaagcttcagaaattgctactaaagaatttaataatgaaactcctatttcttggaaattagaagatgttaatgatcaagctatttggaaaattgttttaatccgtaatgaacaaaaacgtgaaataaaaattaatgccgaaacaaaagaattatta

SEQ ID NO: 110 - protein, 193 aa, Lactobacillus acidophilus
MKRFLTFILSIFAGIAIGIAISHANQETRKTSNVTVHVGDFLNKTQAVSYSTDKLPTIRVNQASAIRKFKSLYSNAVIKSISLTLNKDIYVYNIIGFDDRKDCMIQVDATNNKIIGQSTQVLNYDFDKESYLNLNKTISRSEASEIATKEFNNETPISWKLEDVNDQAIWKIVLIRNEQKREIKINAETKELL

SEQ ID NO: 111 - DNA, 900 bp, Lactobacillus acidophilus
  CDS (1)..(900): PrtM precursor ORF# 1588
atgaagagttatatgaaaaaagttgctgcagtcgtcgctgtagctggtgttgcattatctactgccgcttgttcaaacagtggtagcaattctactgttgcttcttacaaaggtggtaagattactcaacaacaatactatgatgaaatgaaaaagtcacaagctggtaaatcaactttggctaacatgattatcaaccgtgctttggaacaacaatacggcaaatacgtatcatcaaagaaagttgacaagcaatacaacaactacaagaagcaatatggctcacaatttagtgctgttttacaacaaaatggtatgactgcttcaagtttcaaagaaaacttaaagactaatcttctttctgaacaagcattaaagcatattaagaagattactaaaaagcaagaacaacaagcttggaagagctaccaacctaaggtaactgttcaacatattttggttgctaagaagtcaactgctcaagacattatcaagcaattaaaagatggtaagagcttcagtagcttagctaagaaatactcactcgatactgcaactaagaataaagctggtaagcttccttcatttgactcaactgacaacactcttgactcagcattcaagactgctgcatttaagcttaagactggtgaagttacttcaactccagttaaatcacaatcaggctaccacgtaattaagatgattaaccacccagctaagggtaaatttgctgatcacaagaaggctattgatgatgaaatttatgcatcaatggctcaagatcaatcaactatgaaagacgttatcgcaactgtattgaagcgtgctgatgtttcaattaaggatagcgacttgaaggacgtattatcagcttacgtatcaactggtgctactaag

SEQ ID NO: 112 - protein, 300 aa, Lactobacillus acidophilus
MKSYMKKVAAVVAVAGVALSTAACSNSGSNSTVASYKGGKITQQQYYDEMKKSQAGKSTLANMIINRALEQQYGKYVSSKKVDKQYNNYKKQYGSQFSAVLQQNGMTASSFKENLKTNLLSEQALKHIKKITKKQEQQAWKSYQPKVTVQHILVAKKSTAQDIIKQLKDGKSFSSLAKKYSLDTATKNKAGKLPSFDSTDNTLDSAFKTAAFKLKTGEVTSTPVKSQSGYHVIKMINHPAKGKFADHKKAIDDEIYASMAQDQSTMKDVIATVLKRADVSIKDSDLKDVLSAYVSTGATK

SEQ ID NO: 113 - DNA, 1311 bp, Lactobacillus acidophilus
  CDS (1)..(1311): Aminopeptidase G ORF# 195
atgaaacacaagctgacaatggcagaaattgccaaatttcaacaagaatatgagaagcaacctagaaatcgtgttgctgaacttgcagtagtgaataatggtgtacaaaaggccagctttaataatgagggggttagaaagctaaatcgtacattttctattgaaattcccacagataatgtaactgatcaaaaacaatcgggtcgctgctggttatttgcagcattgaatacgcttcgccatggctttgctaaaaagcaaaatgctaagaattttactttttcacaaaattatctattcttctgggatagagtagaaagagccaatatcttctttgataatattttaaatactgcggataagccactggatgacagaacggttcatacctatatgcaaggtcctgatactgatggtggtcaatgggctatggctgtttctttaattagaaagtatggtttagttccaacatatgcacaagatgaaagctttactgctaacaatacagctgcgtttaatagcgccttaaatatgaaactgcgtgaagatggtttagtattgcgtaaactttatcaagaaaagaaaatggatgaaatcgaaactaaacgtcaagaatttttgagtgaagtttatagaatggctgttattgcatttggtgaaccagttcaaaaatttgatcttgaatttaaagatgataatggcaattatcattttgatgggaatttaactccattagacttcttccacaattatttcactgatgatctagatgattacattgttttgtttaatgcacctgatcatgaatttgataagctttatgctcttccatttgaagataatgttgaaggcggcacaccagtacaatttttgaatacagaaattgataatttaaaagaagcggctattaagcagcttgaagctggtgaaactatttggtttggttgtgatgttggtaaagagagtgatcgtcaaaaaggtatcttgtctaagggtctttaccaaacagatttaatttttgatattgaaactaagttaaataaaaaagaaagattacaaactggtgcttcaggctcaacgcatgccatgactttagtgggagttgacgttgtagacggacagcctcaacaatggaaggttgaaaattcatggggcagtaaggtcggtgaaaagggctactttgtcatgaatgatgagtggtttaatgaatacttattcaaggtggttgtaaaaaagcaatatgtaccagaaaaattaattaagatctgggaaggcgaagcaacaccagtagaagcatgggactcaatggca

SEQ ID NO: 114 - protein, 437 aa, Lactobacillus acidophilus
MKHKLTMAEIAKFQQEYEKQPRNRVAELAVVNNGVQKASFNNEGVRKLNRTFSIEIPTDNVTDQKQSGRCWLFAALNTLRHGFAKKQNAKNFTFSQNYLFFWDRVERANIFFDNILNTADKPLDDRTVHTYMQGPDTDGGQWAMAVSLIRKYGLVPTYAQDESFTANNTAAFNSALNMKLREDGLVLRKLYQEKKMDEIETKRQEFLSEVYRMAVIAFGEPVQKFDLEFKDDNGNYHFDGNLTPLDFFHNYFTDDLDDYIVLFNAPDHEFDKLYALPFEDNVEGGTPVQFLNTEIDNLKEAAIKQLEAGETIWFGCDVGKESDRQKGILSKGLYQTDLIFDIETKLNKKERLQTGASGSTHAMTLVGVDVVDGQPQQWKVENSWGSKVGEKGYFVMNDEWFNEYLFKVVVKKQYVPEKLIKIWEGEATPVEAWDSMA

SEQ ID NO: 115 - DNA, 1950 bp, Lactobacillus acidophilus
  CDS (1)..(1950): PepO neutral endopeptidase (EC3.4.-.-) ORF# 165
atgagtaataaagtgactgttcgtggtggtgctggtaatatcctcgaacctaaagttggtactcgtccacaagataatttatatttagctgttaactcagactggcttgagaaggctaagattccttcagatcgttcaagaattgctagttttgatagtattgatcttaacgtagaaaagagcttaatgaaggatttcgcagattttgcggatggcaaaaaagaagtagccgatgtaccgaacttgaagaaggcagttgaactatataagcttgctcgtgactttaagcgtcgtgatgaagatggcgctaagcctattcaagctgatttgttcttacttgaaagtatcagtgactttgctgatttcaacttgaaggctgctgatttatttaaggcttcattttcattgccatttggtttagatattgatgctgatatgaagaatactaagattaatgttcttcaatttattggaccatcaacattcttgccagatactactacttacaagacagaagctgctggaaagcttttggaagttttgaagaagcaatcaattaacttgcttaagatggctggcgtttctgaaggtcaagctaaggaatacgtggaagatgccttaaaatttgataaaaagctttctgaagtagttaaatcatcagaagaatgggcagattatccagcaatgtataatccaacttcaatggaagattttgaaggcaagattaagaacttcaagattgattacttcttgaaggaagctttaggtgaagttcctgatagaattattgttactgaaccacgtttcttgaaacactttgatgaattaatgaatgaagaaaactttgatgaaattaagggttggatgatcgttaagtttattaataatgttgcaagttacttgtcacaagatttccgtgaagcatcattccaatttagtcaagcattgacaggccaaccggaattacaaagccaagaaaagcaagcatatcatttagctaatggtctattcagcgaagtagtcggtgtttactatggtcaaacatactttggtgaagaagctaaaaaagatgttttaactatgattcgccaaatgattgatgtttacgaaaagcgtattaaggaaaattcatggctttctgaagaaactaaggaaaaggctattgttaagcttcgtgcattgatcttaaagattggttaccctgataagattgaagaaatctataatcgctacaatataactcctgctagtgaaggcggtagtctttactcaaacgtaagagcagctgatattgaacaagttaaatataacgttgaaaagttacataaaccagttgatcgtagcgtatggctcatgccagccaacttggtaaatgcttgctatgatccacaaagaaatgacttaactttcccagcagcaattttgcaagcaccattttatgacttaaagcaagatcgtgctgaaaactttggtggaattggtactgttattgctcatgaaatttctcatgcctttgataacaatggtgcacaattcgatgaattcggtaatatgaagaattggtggactgaagaagacttcgctgaatttaagaagcgtactcaagcagaaatcgacttgttcgatggtattaaatacggccctgttactttgaacggtaagcaaatcgtttcagaaaatattgccgaccaaggtggtcttactgcagctattaaggcagctaaggacgaaggcgatgatttgaagaaattgtttgaaaactttgctcgtatttgggctaacaagcaacttactgaatctattaagacacaagtttcttttgatgttcacgcaccaggtccagaacgtgcaaatgttcaatcacaatgtcaagaagacttctatgaagtatttgatgttaaggaaactgatggtatgtggttagatccagaaaaacgtgtagttatttgg

SEQ ID NO: 116 - protein, 650 aa, Lactobacillus acidophilus
MSNKVTVRGGAGNILEPKVGTRPQDNLYLAVNSDWLEKAKIPSDRSRIASFDSIDLNVEKSLMKDFADFADGKKEVADVPNLKKAVELYKLARDFKRRDEDGAKPIQADLFLLESISDFADFNLKAADLFKASFSLPFGLDIDADMKNTKINVLQFIGPSTFLPDTTTYKTEAAGKLLEVLKKQSINLLKMAGVSEGQAKEYVEDALKFDKKLSEVVKSSEEWADYPAMYNPTSMEDFEGKIKNFKIDYFLKEALGEVPDRIIVTEPRFLKHFDELMNEENFDEIKGWMIVKFINNVASYLSQDFREASFQFSQALTGQPELQSQEKQAYHLANGLFSEVVGVYYGQTYFGEEAKKDVLTMIRQMIDVYEKRIKENSWLSEETKEKAIVKLRALILKIGYPDKIEEIYNRYNITPASEGGSLYSNVRAADIEQVKYNVEKLHKPVDRSVWLMPANLVNACYDPQRNDLTFPAAILQAPFYDLKQDRAENFGGIGTVIAHEISHAFDNNGAQFDEFGNMKNWWTEEDFAEFKKRTQAEIDLFDGIKYGPVTLNGKQIVSENIADQGGLTAAIKAAKDEGDDLKKLFENFARIWANKQLTESIKTQVSFDVHAPGPERANVQSQCQEDFYEVFDVKETDGMWLDPEKRVVIW

SEQ ID NO: 117 - DNA, 1314 bp, Lactobacillus acidophilus
  CDS (1)..(1314): Aminopeptidase E ORF# 204
atggctcatgaactcactgtgcaagaactagaaaagttctctgctgattttaacaagaatccaaagaataaaattattgctcgtgcggctcaacgtagcggtgtgctcgaagcatcttacaacgatcgcgtagaaggtgaattaactcgcgttttttcaacggaattagatactgacaacgttactaaccaacttcactcaggtcgttgctgggagttttcaaccttaaatgttttgcgtcatgcatttggcaagaagtacaaagcaaagaactttaccttctcacaagcctacaacttcttctgggataagattgaacgtgctaatatgttctacaatcgtatcttagatagtgctgacatgcctcttgattctcgtcaagtgaaagctgatctcgactttgctggtgcagacggtggacaattccaaatggctgccgcattagtagaaaaatatggcgttgttccttcatacgcaatgcctgaaactttcaacactaataatacaactagctttgcgacagctcttggtgacaagcttaaaaaagacgcattagttcttcgtgaattaaagcaatatggtaaagatgacgaaatcgctaagactcgtgaaaaattcttgagtgaagtttaccaaatgactgctatcgctgtcggtgaaccacctaagacgtttgatcttgaatatcgtgatgatgataagaaatatcatttagacaagaatcttacaccacttgaattcttacataagtatatgggtgaggttgattttgatgactatgttgttttaactaatgcacctgatcatgaatacaacaagttatacggtcttccagcagaagataacattgaaggctcacttagaatcaagcttttaaatgtacctatggaatacttatcatcagctgctattgctcaattaaaagatggtgaagcagtatggtttggtaacgatgttcttcgtcaaatggaccgcaagactggttatcttgatactaacctttacaaacttgacgatttattcggcgttgatcttaagatgtctaaagctgacagattaaggactggtgttggtgaagtttcacacgcaatgaccttggttggtgttgatgaagataatggcgaaatccgtcaatggaaggtcgaaaactcatggggcgaaaaatctggttctaaaggattctttgttatgagtaatgactggttcaacgactatgtatatgaagttgttgttcacaagaagtatttaaccgataagcaaaaagaacttgcagaaggtcctattaccgacttgcctgcatgggattcattagct

SEQ ID NO: 118 - protein, 438 aa, Lactobacillus acidophilus
MAHELTVQELEKFSADFNKNPKNKIIARAAQRSGVLEASYNDRVEGELTRVFSTELDTDNVTNQLHSGRCWEFSTLNVLRHAFGKKYKAKNFTFSQAYNFFWDKIERANMFYNRILDSADMPLDSRQVKADLDFAGADGGQFQMAAALVEKYGVVPSYAMPETFNTNNTTSFATALGDKLKKDALVLRELKQYGKDDEIAKTREKFLSEVYQMTAIAVGEPPKTFDLEYRDDDKKYHLDKNLTPLEFLHKYMGEVDFDDYVVLTNAPDHEYNKLYGLPAEDNIEGSLRIKLLNVPMEYLSSAAIAQLKDGEAVWFGNDVLRQMDRKTGYLDTNLYKLDDLFGVDLKMSKADRLRTGVGEVSHAMTLVGVDEDNGEIRQWKVENSWGEKSGSKGFFVMSNDWFNDYVYEVVVHKKYLTDKQKELAEGPITDLPAWDSLA

SEQ ID NO: 119 - DNA, 1419 bp, Lactobacillus acidophilus
  CDS (1)..(1419): Dipeptidase (EC3.4.13.18) ORF# 1294
atgaaagaatatagtgcttgtactaccatcttagttggtaaaaatgcctcaattgatggcacaactatgattgctcgtaatgatgataccttccgcccaattactccacaaaagtttattattgagccagctcgtcatggcgaaaagaaacatattaaatcatggcttaataagtttgagatggatcttccagaagatgcacaacgagttcctgccgtaccaaatgttgattataaacatcgtggttactacgatgaaagtggtattaaccaagaaaatgttgctatgtcatgtactgaatcaacttatggtaatgaaagaactttagcatttgatccattggttaaagatggattagatgaagactgtatgcaaaccgtagttttgccatacattcattcagcacgtgatggtgttaagtatttaggtaagttaattgctaagtatggctcaccagctggtaactctgttttgttcagtgataaagatgaaatttggtacatggaaattgtaactggtcaccactgggtagcagaacgtattcctgatgattgctatgctgcaactggtaaccgtgtagctattgaacaagtcgatttcgataatcctgaatacttcatgtggagtgaaggaattcaagaatttgttgaagaacatcacttgaatccagatcatgaaggttggaatttccgtcatatctttggtacttacactgaacaagatcgccactacaatactaaccgtcaatggtatattcaaaagttgttcaacccagaaattgaacaagatccacaagatggcgatattccatttattcgtaaggcagctaagaagattaccaaggaagatattgaatttgccttaggttcacattatcaagatactccatatgatccatttggtaagggtaccgaagaagaaaagcaccgctaccgtcctattggtttgaaccgtacgcaaaatgctcatattttacaaataagaagtgatgtaccagcagaccgtgcagcaattatgtggttatgtattggtggtccaacgtttactccatttatcccattctttgctaatatgaatgaaactgatccttcatttaacaatacttcaatggattacaatatgagtgatgcatggtggtactacaagtcatttgctgcacttgttgaaagccactatccacaatttgttcaacttgatactacttatcttactgaacttaatcgttacttcagaggtcgtgttgaagaaattattaagaattcagaaggtaaatcaggcgatgaattaactgaatacttaactaaagaaaatcaaaagactgttgctcatactcgcaaggaaactgaaaagttatggggagaaatgatgattgattcaattaatatgtctaagttgacttttaatatggatgaaaatctc

SEQ ID NO: 120 - protein, 473 aa, Lactobacillus acidophilus
MKEYSACTTILVGKNASIDGTTMIARNDDTFRPITPQKFIIEPARHGEKKHIKSWLNKFEMDLPEDAQRVPAVPNVDYKHRGYYDESGINQENVAMSCTESTYGNERTLAFDPLVKDGLDEDCMQTVVLPYIHSARDGVKYLGKLIAKYGSPAGNSVLFSDKDEIWYMEIVTGHHWVAERIPDDCYAATGNRVAIEQVDFDNPEYFMWSEGIQEFVEEHHLNPDHEGWNFRHIFGTYTEQDRHYNTNRQWYIQKLFNPEIEQDPQDGDIPFIRKAAKKITKEDIEFALGSHYQDTPYDPFGKGTEEEKHRYRPIGLNRTQNAHILQIRSDVPADRAAIMWLCIGGPTFTPFIPFFANMNETDPSFNNTSMDYNMSDAWWYYKSFAALVESHYPQFVQLDTTYLTELNRYFRGRVEEIIKNSEGKSGDELTEYLTKENQKTVAHTRKETEKLWGEMMIDSINMSKLTFNMDENL

SEQ ID NO: 121 - DNA, 579 bp, Lactobacillus acidophilus
  CDS (1)..(579): PepQ ORF#1343
atggcagttaaagaggcacattctaagcacatgactgtatgtgcacatgcagaaggaaaaatggaaattcattatgctgttgttgccggagtagattctgttgagcatggtttttatgtaagtgatgaagatattgaattaatgaaaaaacaaggtacatttttatcaccaacgttaattgctggacatcaaattgtggaatatggtaaaggaaaaatgaccgatttttcatatcagaagatgtgtcagcatgtagaggcattttatgaacatgttggtaaagcaattaaagcaggtgttaaattagcgttaggaaccgatgcaggcacatttatgaatccattagaagatactgctaaagaattaaaagaattaactagagctggtacaagcaattaccaagccttacgtgctgcaggattaggatctgctgaattattaaaaattgatcgaaattatggatcgcttgaagttggaaaatatgcagattttttagtattaaagaataatccactaactgatgtaacggctgttgagcaagttgataagcaagtttatcagcatggtaagcgaaaatat

SEQ ID NO: 122 - protein, 193 aa, Lactobacillus acidophilus
MAVKEAHSKHMTVCAHAEGKMEIHYAVVAGVDSVEHGFYVSDEDIELMKKQGTFLSPTLIAGHQIVEYGKGKMTDFSYQKMCQHVEAFYEHVGKAIKAGVKLALGTDAGTFMNPLEDTAKELKELTRAGTSNYQALRAAGLGSAELLKIDRNYGSLEVGKYADFLVLKNNPLTDVTAVEQVDKQVYQHGKRKY

SEQ ID NO: 123 - DNA, 1515 bp, Lactobacillus acidophilus
  CDS (1)..(1515): Aminopeptidase N ORF#1567
atgaaaaaaagaacaacacttttattatcaagtgcaataacaattgcagcattatttagttttaattcaaaggctcaggccgctgccgatcccgcagtcaaagcaaccaactacaatatgactgtaaaactaaatactcgcaaaaatcaactaaccgaaaaagttaccatgcatgtcgttaataacggcaatgaaccagttaagaacttactgatcagaaatattgctaatggtgttttaaagtatgaccatcagcattttaaaattgccaaaaatgcaaaaactacagttaaaagtatttcctcagctggagaaaatctttcctataccactggcaaagataagagcaacctattcgttgataaaagcttaaatgcaggtgaatctaccgacttaactgttaatgtagtcaccagcgttcccaaaagacaagatcgttttggctaccaaaatattaatggcggtaaagtttataacttatccttctgttttccttacctaagcgattatcgcaacggaaaatggaattaccatccatattatgacggtggtgaaaaccgtaataccactgtcagcaattttcatgttagcttttatgcaccaaagagttacaaggttgctgcttcaggacaaaatagcaccaaaaatggcaagactacaatcgttgcggaaaatatgagagattttgctatcgttgcttctaataaattcaaggtttctcatacttatgcagatggtataagaattaataattattattttgccggtaaaaatagtaagcaatataacaaacttgccttattgactgctaaagatagtttcaatattttcaccaagaaaattggtaaatatccttataaagaaatcgatatgactgaaggcttacttggtaaagataccggtggaatggaatatcctagtttaattatgatcgatgcgagtggctttgtacaaaagaaacacccaatcaacagatacaatgaattaaccgaagatgtttcccatgaaattggtcaccaatggttctacgctactgttggcaatgacgaatacaccgagccatggcttgatgaaggacttactaatttccttgaaaacagtgtttatgatttaacttatactaagagtaaagcctatactgctaaacttatgcacaacaaactttataatcgtaaaacagtgaaaaaggcaaatcaagttctggctaacttagctaatacctttttaaccgatcatcgtcaaaaaggtatctacgttaaccgtcctctcaacaatccaccaaaaggaatcgatactgacgagatggcttatgaagccggtagttctttcccagcaatcttaatgatcgctatgggtaaaaagaaattctttaatgctttgcatgattactatgaaacctactacttaaaacaagctactacacaggattttttgaatatcattcgtaagtatgacaactcaaagaaagtaaactatgtgattaatcaatttatcgatcctgattatttgaacaaa

SEQ ID NO: 124 - protein, 505 aa, Lactobacillus acidophilus
MKKRTTLLLSSAITIAALFSFNSKAQAAADPAVKATNYNMTVKLNTRKNQLTEKVTMHVVNNGNEPVKNLLIRNIANGVLKYDHQHFKIAKNAKTTVKSISSAGENLSYTTGKDKSNLFVDKSLNAGESTDLTVNVVTSVPKRQDRFGYQNINGGKVYNLSFCFPYLSDYRNGKWNYHPYYDGGENRNTTVSNFHVSFYAPKSYKVAASGQNSTKNGKTTIVAENMRDFAIVASNKFKVSHTYADGIRINNYYFAGKNSKQYNKLALLTAKDSFNIFTKKIGKYPYKEIDMTEGLLGKDTGGMEYPSLIMIDASGFVQKKHPINRYNELTEDVSHEIGHQWFYATVGNDEYTEPWLDEGLTNFLENSVYDLTYTKSKAYTAKLMHNKLYNRKTVKKANQVLANLANTFLTDHRQKGIYVNRPLNNPPKGIDTDEMAYEAGSSFPAILMIAMGKKKFFNALHDYYETYYLKQATTQDFLNIIRKYDNSKKVNYVINQFIDPDYLNK

SEQ ID NO: 125 - DNA, 1410 bp, Lactobacillus acidophilus
  CDS (1)..(1410): Cytosol non-specific dipeptidase ORF#1837
atgaatactacagtcgttggtcgttcgtcttgtacctcaatcttaattggtaagaaagcatccctttcaggcagtgtaattattggccgcaatgaggatgcaaaaactgcttggccaaaacatcttgcattcaatcaccataagaatgttaagaataaccattttaagtcaaaagacaataaatttgaaattgatttacctgaaaagatattcagctattcttccacaccagaatggacagataaatacggtgtttttgaagaagatggcattaatgagtatcatgtggcaatgagtgctactgaaagtgcctatgccaatgatcgtgtaatggcagttgatccattcaatacagaaaagggcatcctagaagaagctatggtaacggtagtattgccatatattaaaacagcaaaagaaggcgttattcgcttaggcaaaatcgttgaaaaacatggtgccgctgaagcagacgggatcttatttgctgaccgcgacgaagcatggtacatggaaattggatcaggtcaccactgggttgctcaaagaattccagatgattcatatgcagtagttgctaaccaattagcaattcaagaaattgactttgacagtgacaatttcttatattcaaataatttacaaaattttgtttataacaatcaactttggccaaaagataaaccatttatttggcgtgatatttttggtacacatgacgatagtgatcttcattacaatacgccacgtgtttggagcggtcagcgtcttttaacgccatctgctgaacaaaagcctcaagacttcaatttaccatttaccagaaagcctgatgcgcctatttctgcccaagatgctcaacatgttttaagtgatcactttaataatacagtttatgatctaacaaataagaaaaataaagatcagcctgcatttcgtccaatttctgtagctactactcaagaatcacatttgcttgaattaaacggcgaagacatgattcattggctagcaatgggcgttgccgcacaaagcgtatatattccgttctatccacaaggtactaaagttcctagtacctggaaaaacggtaaagagacttattcaccgaattctgcctactgggtatttaagcttgccagcgttttagttgatcgcgattggagtaagtacggtactgcattgagtaatacccaaaactctactaatgagaaattattgcaaattagacatcaatatgatgaaaaattagctaaggaaaatgatcctgctaaacgaactgatttaattaatgaagcaaatgctaaactggctaagacagctacagacgcatataaagaattaactgcaaaattgattactgaacaaactggtgattcaccacttagattccaaatggatcctaaccta

SEQ ID NO: 126 - protein, 470 aa, Lactobacillus acidophilus
MNTTVVGRSSCTSILIGKKASLSGSVIIGRNEDAKTAWPKHLAFNHHKNVKNNHFKSKDNKFEIDLPEKIFSYSSTPEWTDKYGVFEEDGINEYHVAMSATESAYANDRVMAVDPFNTEKGILEEAMVTVVLPYIKTAKEGVIRLGKIVEKHGAAEADGILFADRDEAWYMEIGSGHHWVAQRIPDDSYAVVANQLAIQEIDFDSDNFLYSNNLQNFVYNNQLWPKDKPFIWRDIFGTHDDSDLHYNTPRVWSGQRLLTPSAEQKPQDFNLPFTRKPDAPISAQDAQHVLSDHFNNTVYDLTNKKNKDQPAFRPISVATTQESHLLELNGEDMIHWLAMGVAAQSVYIPFYPQGTKVPSTWKNGKETYSPNSAYWVFKLASVLVDRDWSKYGTALSNTQNSTNEKLLQIRHQYDEKLAKENDPAKRTDLINEANAKLAKTATDAYKELTAKLITEQTGDSPLRFQMDPNL

SEQ ID NO: 127 - DNA, 897 bp, Lactobacillus acidophilus
  CDS (1)..(897): Prolyl aminopeptidase (EC3.4.11.5) ORF# 1957
atggatcaaacaagattagtaactttagataatggttatcacctatttacacgaaaagtcaatgaaggacctattaaactgctttgcttacatggtggccctggcggaacacatgaaacttttgataattttaaagatggcttaaaagggcaaggcgttgaagtttattcatatgatcaattaggatcttactattctgatcaacctgattttactaaaaaagaaaataaatcattactttctatccctcgatatgtcgacgaagtcgaagaagtaagacaaaagttaggcttagataacttttacttgttgggacattcatggggtggacttcttgctcaagaatatgcttacaaatatggcaaacacctaaagggcctagttctaatgtcaatgattgataacttagatgaatatacagaaaatattaatcatgaacgtgaagaaactttttcacctgaacaagttgattacatgaaagaatgtgaaaaagctgagaactttactgaccctatgtatcagcaattagttgctcatctttattccctctttttaacaagacatcccacaggtacagctcatcctgtaaatactcacaataatgtgatttacaactatttccaaggaaataatgaatttgttatggtgggtgagcttaccaaatgggatttcagagagaaactagcaagtttgaagatgccaactttattaacctttggagaattcgatactatgccactttcagctgctcgcagaatgcatcaaacactaagtaattcacgcttaactttaactccggatggcggacattgtcataatactgataatccaaaagcattcttcacgtctttaactaagtttttacacgatgttgagaacaacacattcaagggagaa

SEQ ID NO: 128 - protein, 299 aa, Lactobacillus acidophilus
MDQTRLVTLDNGYHLFTRKVNEGPIKLLCLHGGPGGTHETFDNFKDGLKGQGVEVYSYDQLGSYYSDQPDFTKKENKSLLSIPRYVDEVEEVRQKLGLDNFYLLGHSWGGLLAQEYAYKYGKHLKGLVLMSMIDNLDEYTENINHEREETFSPEQVDYMKECEKAENFTDPMYQQLVAHLYSLFLTRHPTGTAHPVNTHNNVIYNYFQGNNEFVMVGELTKWDFREKLASLKMPTLLTFGEFDTMPLSAARRMHQTLSNSRLTLTPDGGHCHNTDNPKAFFTSLTKFLHDVENNTFKGE

SEQ ID NO: 129 - DNA, 756 bp, Lactobacillus acidophilus
  CDS (1)..(756): Conserved membrane protein plnI ORF#553
atgattgaaaaacgaaatttcaagaaatcaattgctatctggatctgtttattattagtgtatacattggctggtctagtactgcgaccaatcaataatttaaccttacgcttagcgatccgttgttttattgctctagttattacaggattctgtttttattttatgcatggcagcaagctttattctaacgagcttaatttgcgacacattaaaatttataacactatttttattattattgttgctatcttctatttattttttcgcctgccaatttggattgaattatttactactcaaagaagcggattaatcaattctttactgattgcagtttgtgcaggattttgtgaagaagccttgtttagaggaatgttgtttaatatctgcgctaattatttgaaaaaacatcggtatatttggcttgaaacagctttagttacttcaattctttttggactaatgcactcagtcaatttgctttccagtgagccactaccctctgtaggtacacaagttttttacgcttttgccagcggattaatgtttgcatacctgcgtttaatgtctaaccatctttggccagctatcttggctcatgctgcctttgattttacaatcgtacctaaaaatgcggtatttgcaatcaacgctcaaggattatcactagtttacataatttttggtattcttaccgttatctatttattgttcatttggagcttcaacagattgtacaatgaaactaaagcc

SEQ ID NO: 130 - protein, 252 aa, Lactobacillus acidophilus
MIEKRNFKKSIAIWICLLLVYTLAGLVLRPINNLTLRLAIRCFIALVITGFCFYFMHGSKLYSNELNLRHIKIYNTIFIIIVAIFYLFFRLPIWIELFTTQRSGLINSLLIAVCAGFCEEALFRGMLFNICANYLKKHRYIWLETALVTSILFGLMHSVNLLSSEPLPSVGTQVFYAFASGLMFAYLRLMSNHLWPAILAHAAFDFTIVPKNAVFAINAQGLSLVYIIFGILTVIYLLFIWSFNRLYNETKA

SEQ ID NO: 131 - DNA, 846 bp, Lactobacillus acidophilus
  CDS (1)..(846): Serine protease ORF# 601
atgaaaactgggttagtgttagaaggcggtgcaatgcgtggattatttaccgctggtgtgatcgatgtcttaatggaaaacaagattaattttgatgtagcaattggagtttccgctggagctgcttttggcgttaatctgaaatccaaacaaattggccgagttctgcgttataatttacgttttgcaggtaaatcttattatgcaagttggaagtcatggcgtagatctggtaatttgtatgctgctaatttttgctatcatattttgccagataagttagatatttttgataaagaaacttttatggctaatccaatgcgattctgttgtgtagcgactgatgctgcaacgggagagcctgtttatcatgagttgtacgatgctgggtatgtagatttagagtggattagggcatcctcttcaattccattttttgctcatcctgttgctattggtggccattattattttgacggcggagtttctgattctattccatatgattttttgataaagaacggtgtttctaaaagggtagtaattacaacgcaacctaaagaatatcgtaaaaagcaaagtaagctatatccaattgaaaaaattgtactacgtgaatatcctgctgttttaaagaaattagctactagagcagaagattataatgcggttttagataagatggaagaagatgaaaatcaggggaatgcatttattattcgtccgccatatccgctagaaattggtactgttgaacaaaataaagaagagattaaacgggtatatgagatcggacgaaaaaaggcagaagaaattctgccagatttggttgaatatttgaaagac

SEQ ID NO: 132 - protein, 282 aa, Lactobacillus acidophilus
MKTGLVLEGGAMRGLFTAGVIDVLMENKINFDVAIGVSAGAAFGVNLKSKQIGRVLRYNLRFAGKSYYASWKSWRRSGNLYAANFCYHILPDKLDIFDKETFMANPMRFCCVATDAATGEPVYHELYDAGYVDLEWIRASSSIPFFAHPVAIGGHYYFDGGVSDSIPYDFLIKNGVSKRVVITTQPKEYRKKQSKLYPIEKIVLREYPAVLKKLATRAEDYNAVLDKMEEDENQGNAFIIRPPYPLEIGTVEQNKEEIKRVYEIGRKKAEEILPDLVEYLKD

SEQ ID NO: 133 - DNA, 1212 bp, Lactobacillus acidophilus
  CDS (1)..(1212): Zn-dependent peptidase ORF#660
atgctaacaactaatataacaattagaaaaaataaaaaatttacaacagccggaataggctgttttttgcgtttaccgttaactaatcataatttagcttttgctagtttactttcgcgattgcaaatgaatactagtttgtcatatccaacaattgctgctcaacaaagaaagttagcccaattatatgatttgcagcttgatattatgccgcaactttttggcaaccaaattattttgatgtattatgctaattttgttgaaccgattgaagtattggatccagattatacttatgaagaaataatccaaactattagccaaattatcagatttccagcatatgataataatttattcgattatgctaaaagacaacttgaagatgaatatcgtgaaattatggttcaaccttcaaattatgctctcgatcgcttttttaaattatggtatgaagatcaaccagaatatgctgaaaactttatggggccaattgatgaaataaaaaatactacgattgttgagatgcgtgattttattgaaaatttgcgtgatataccaatggcggtaattggcatgggacgagacaatcaattaatgactaaaatactcagaaatatttttaaaggggctggaattattaaaaaattccaagttagtgatttagttattccagctaaaagaaaattaattgaaaaagttgatgagcaagacaatattcaagctcaattattgatgggatttggttttaaacagagaattagttatcaagaacaagttgttggtttgcttttagaacaatatttagctggtgatcagtcttcaaaattatttagtcagattagagaagagttaggtgcggcttatgatgttcaagcaagtgactttgctaataattctctctttttaattaatgctggaattgatcctcaaaaagtagaaccagccaaaagaattattcttaatgaaatgcaaaaattaatggatggtaatatagatgaagagctatttagaaaatccaaaaaggctgtatatcgaaacactaggattgggttagacaatcaaaattggcaattaggacaggccttgcgtgccgaattattaccagattatttagattttgatagagaagctgctataaaaaaagcaacgccacatcaattaattaattttgttcaaaatttattctttaatgaaagttatattttaaaa

SEQ ID NO: 134 - protein, 404 aa, Lactobacillus acidophilus
MLTTNITIRKNKKFTTAGIGCFLRLPLTNHNLAFASLLSRLQMNTSLSYPTIAAQQRKLAQLYDLQLDIMPQLFGNQIILMYYANFVEPIEVLDPDYTYEEIIQTISQIIRFPAYDNNLFDYAKRQLEDEYREIMVQPSNYALDRFFKLWYEDQPEYAENFMGPIDEIKNTTIVEMRDFIENLRDIPMAVIGMGRDNQLMTKILRNIFKGAGIIKKFQVSDLVIPAKRKLIEKVDEQDNIQAQLLMGFGFKQRISYQEQVVGLLLEQYLAGDQSSKLFSQIREELGAAYDVQASDFANNSLFLINAGIDPQKVEPAKRIILNEMQKLMDGNIDEELFRKSKKAVYRNTRIGLDNQNWQLGQALRAELLPDYLDFDREAAIKKATPHQLINFVQNLFFNESYILK

SEQ ID NO: 135 - protein, 5 aa, Artificial
  Consensus peptide sequence
  misc_feature (3)..(3): Xaa can be any naturally occurring amino acid
LPXTG

SEQ ID NO: 136 - protein, 10 aa, Artificial
  Consensus peptide sequence
  MISC_FEATURE (1)..(1): Xaa can be valine or threonine
  MISC_FEATURE (2)..(2): Xaa can be any uncharged amino acid
  misc_feature (3)..(3): Xaa can be any naturally occurring amino acid
  MISC_FEATURE (6)..(6): Xaa can be any uncharged amino acid
  MISC_FEATURE (7)..(7): Xaa can be any uncharged amino acid
  MISC_FEATURE (9)..(9): Xaa can be any uncharged amino acid
  MISC_FEATURE (10)..(10): Xaa can be any hydrophobic amino acid
XXXHEXXHXX

SEQ ID NO: 137 - protein, 5 aa, Artificial
  Consensus peptide sequence
HMEGH

SEQ ID NO: 138 - protein, 5 aa, Artificial
  Consensus peptide sequence
  MISC_FEATURE (4)..(4): Xaa can be aspartic acid or glutamic acid
HDEXH

SEQ ID NO: 139 - protein, 6 aa, Artificial
  Consensus peptide sequence
  misc_feature (3)..(4): Xaa can be any naturally occurring amino acid
HEXXHE

SEQ ID NO: 140 - protein, 5 aa, Artificial
  Consensus peptide sequence
  MISC_FEATURE (1)..(1): Xaa can be histidine or aspartic acid
  MISC_FEATURE (4)..(4): Xaa can be aspartic acid or glutamic acid
XDEXH

SEQ ID NO: 141 - protein, 7 aa, Artificial
  Consensus peptide sequence
  MISC_FEATURE (1)..(1): Xaa can be histidine or aspartic acid
  MISC_FEATURE (6)..(6): Xaa can be aspartic acid or glutamic acid
XDDEEXH

SEQ ID NO: 142 - protein, 4 aa, Artificial
  Consensus peptide sequence
  MISC_FEATURE (1)..(4): Xaa can be leucine or isoleucine
GFTX

SEQ ID NO: 143 - protein, 7 aa, Artificial
  Consensus peptide sequence
  MISC_FEATURE (3)..(3): Xaa can be any hydrophobic amino acid
  MISC_FEATURE (4)..(4): Xaa can be any hydrophobic amino acid
  MISC_FEATURE (7)..(7): Xaa can be any hydrophobic amino acid
GNXXDRX

SEQ ID NO: 144 - protein, 5 aa, Artificial
  Consensus peptide sequence
  MISC_FEATURE (3)..(3): Xaa can be any hydrophobic amino acid
FNXAD

SEQ ID NO: 145 - protein, 16 aa, Artificial
  Consensus peptide sequence
  MISC_FEATURE (1)..(2): Tyr-Phe is optionally present
  misc_feature (7)..(9): Xaa can be any naturally occurring amino acid
  misc_feature (11)..(12): Xaa can be any naturally occurring amino acid
  MISC_FEATURE (14)..(16): Val-Ile-Ala is optionally present
YFSIRKXXXGXXSVIA

SEQ ID NO: 146 - DNA, 240 bp, Lactobacillus acidophilus
  CDS (1)..(240): Signal peptidase I ORF# 1182
atggtagaaaacctaaagaagaaaaaagacgataacgaaagtattggtcgctttgttttagacatagttattatgtttgcaatcttaatgggaatttactactttgtatttagtttcttcctttcaaacgaaactgtttcgggtccgtcaatgcagcctacctttgaaaacaatgatcgtttaatagcagtacgacactttaatcctaaacgaaacgatatcgttaattttaaaagctcc

SEQ ID NO: 147 - protein, 80 aa, Lactobacillus acidophilus
MVENLKKKKDDNESIGRFVLDIVIMFAILMGIYYFVFSFFLSNETVSGPSMQPTFENNDRLIAVRHFNPKRNDIVNFKSS

SEQ ID NO: 148 - protein, 5 aa, Artificial sequence
  Consensus peptide sequence
  misc_feature (3)..(4): Xaa can be any naturally occurring amino acid
HEXXH

SEQ ID NO: 149 - protein, 7 aa, Artificial
  Consensus peptide sequence
  misc_feature (2)..(3): Xaa can be any naturally occurring amino acid
  misc_feature (5)..(6): Xaa can be any naturally occurring amino acid
HXXEXXH

SEQ ID NO: 150 - protein, 4 aa, Artificial
  Consensus peptide sequence
  misc_feature (4)..(4): Xaa can be any naturally occurring amino acid
CAAX

SEQ ID NO: 151 - protein, 4 aa, Artificial
  Consensus peptide sequence
  misc_feature (3)..(4): Xaa can be any naturally occurring amino acid
KKXX

SEQ ID NO: 152 - protein, 5 aa, Artificial
  Consensus peptide sequence
  misc_feature (2)..(4): Xaa can be any naturally occurring amino acid
EXXXD

SEQ ID NO: 153 - protein, 5 aa, Artificial
  Consensus peptide sequence
YSIRK

SEQ ID NO: 154 - protein, 5 aa, Artificial
  Consensus peptide sequence
  misc_feature (2)..(3): Xaa can be any naturally occurring amino acid
HXXEH

That which is claimed:

1. An isolated nucleic acid molecule comprising a nucleotide sequence that encodes a polypeptide having at least 95% amino acid sequence identity to the full length amino acid sequence of SEQ ID NO: 68, wherein said polypeptide has aminopeptidase activity.

2. A vector comprising a nucleotide sequence that encodes a polypeptide having at least 95% amino acid sequence identity to the full length amino acid sequence of SEQ ID NO: 68, wherein said polypeptide has aminopeptidase activity.

3. The vector of claim 2, further comprising a nucleotide sequence encoding a heterologous polypeptide.

4. A microbial cell comprising a heterologous nucleic acid molecule comprising a nucleotide sequence that encodes a polypeptide having at least 95% amino acid sequence identity to the full length amino acid sequence of SEQ ID NO:68, wherein said polypeptide has amino peptidase activity.

5. The cell of claim 4 that is a bacterial cell.

6. A method for producing a polypeptide, comprising culturing a cell comprising a heterologous nucleic acid molecule encoding said polypeptide under conditions in which the nucleic acid molecule encoding the polypeptide is expressed, said polypeptide comprises an amino acid sequence having at least 95% sequence identity to the full length amino acid sequence of SEQ ID NO:68.

7. The cell of claim 5, wherein said bacterial cell comprises a lactic acid bacteria or *lactobacillus acidophilus*.

8. The isolated nucleic acid molecule of claim 1, wherein said nucleic acid molecule comprises a nucleotide sequence having at least 95% sequence identity to the full length nucleotide sequence of SEQ ID NO: 67.

9. The isolated nucleic acid molecule of claim 1, wherein said nucleic acid molecule comprises the full length nucleotide sequence of SEQ ID NO: 67.

10. The isolated nucleic acid molecule of claim 1, wherein said nucleic acid molecule encodes a polypeptide having the amino acid sequence set forth in SEQ ID NO: 68.

11. An isolated nucleic acid molecule comprising a nucleotide sequence that hybridizes under stringent conditions to the full length complement of SEQ ID NO:67, wherein said nucleic acid molecule encodes a polypeptide having aminopeptidase activity, wherein said stringent conditions comprise hybridization in 50% formamide, 1M NaCL, 1% SDS at 37° C. and a wash in 0.1×SSC at 60° C. to 65° C.

12. The cell of claim 4, wherein said nucleic acid molecule comprises a nucleotide sequence having at least 95% sequence identity to the full length nucleotide sequence of SEQ ID NO:67.

13. The cell of claim 4, wherein said nucleic acid molecule comprises the full length nucleotide sequence of SEQ ID NO:67.

14. The cell of claim 4, wherein said nucleic acid molecule encodes a polypeptide having the amino acid sequence set forth in SEQ ID NO:68.

15. The cell of claim 4, wherein said heterologous nucleic acid molecule is in a vector.

* * * * *

UNITED STATES PATENT AND TRADEMARK OFFICE
CERTIFICATE OF CORRECTION

PATENT NO. : 7,455,992 B2  
APPLICATION NO. : 11/062665  
DATED : November 25, 2008  
INVENTOR(S) : Klaenhammer et al.

Page 1 of 1

It is certified that error appears in the above-identified patent and that said Letters Patent is hereby corrected as shown below:

Column 23,
Line 67, "≧" should read --≥--.

Column 43,
Lines 29 and 30, "famesylated" should read --farnesylated--.

Column 46,
Line 25, "SIxxxGxxS" should read --SIRKxxxGxxS--.

Column 54,
Line 4, "Q055231" should read --Q05523|--.

Signed and Sealed this

Twenty-sixth Day of May, 2009

JOHN DOLL  
*Acting Director of the United States Patent and Trademark Office*